US012594301B2

(12) United States Patent
Gehrke et al.

(10) Patent No.: US 12,594,301 B2
(45) Date of Patent: Apr. 7, 2026

(54) COMPOSITIONS AND METHODS FOR TREATMENT OF LIQUID CANCERS

(71) Applicants: Beam Therapeutics Inc., Cambridge, MA (US); UCL BUSINESS LTD., London (GB)

(72) Inventors: Jason Michael Gehrke, Cambridge, MA (US); Aaron D. Edwards, Cambridge, MA (US); Ryan Murray, Cambridge, MA (US); Waseem Qasim, London (GB)

(73) Assignees: Beam Therapeutics Inc., Cambridge, MA (US); UCL BUSINESS LTD., London (GB)

( * ) Notice: Subject to any disclaimer, the term of this patent is extended or adjusted under 35 U.S.C. 154(b) by 203 days.

(21) Appl. No.: 17/762,690

(22) PCT Filed: Sep. 25, 2020

(86) PCT No.: PCT/US2020/052822
§ 371 (c)(1),
(2) Date: Mar. 22, 2022

(87) PCT Pub. No.: WO2021/062227
PCT Pub. Date: Apr. 1, 2021

(65) Prior Publication Data
US 2023/0021636 A1 Jan. 26, 2023

Related U.S. Application Data

(60) Provisional application No. 62/907,254, filed on Sep. 27, 2019.

(51) Int. Cl.
| | |
|---|---|
| *A61K 35/12* | (2015.01) |
| *A61K 40/11* | (2025.01) |
| *A61K 40/22* | (2025.01) |
| *A61K 40/31* | (2025.01) |
| *A61K 40/41* | (2025.01) |
| *A61K 40/42* | (2025.01) |
| *C07K 16/1271* | (2026.01) |
| *C07K 16/28* | (2006.01) |
| *C12N 5/0783* | (2010.01) |

(52) U.S. Cl.
CPC ............. *A61K 35/12* (2013.01); *A61K 40/11* (2025.01); *A61K 40/22* (2025.01); *A61K 40/31* (2025.01); *A61K 40/418* (2025.01); *A61K 40/4215* (2025.01); *A61K 40/4224* (2025.01); *C07K 16/1271* (2013.01); *C07K 16/2803* (2013.01); *C12N 5/0636* (2013.01); *A61K 2035/122* (2013.01); *A61K 2035/124* (2013.01); *A61K 2239/48* (2023.05)

(58) Field of Classification Search
CPC ........ A61K 35/12; A61K 40/11; A61K 40/22; A61K 40/31; A61K 40/418; A61K 40/4224; A61K 2035/124; C12N 5/0636; C12N 2510/00; C07K 14/705
See application file for complete search history.

(56) References Cited

U.S. PATENT DOCUMENTS

| | | | |
|---|---|---|---|
| 7,915,114 | B2 | 3/2011 | Hsiao et al. |
| 9,068,179 | B1 | 6/2015 | Liu et al. |
| 9,322,037 | B2 | 4/2016 | Liu et al. |
| 9,388,430 | B2 | 7/2016 | Liu et al. |
| 9,512,446 | B1 | 12/2016 | Joung et al. |
| 9,737,604 | B2 | 8/2017 | Liu et al. |
| 9,783,591 | B2 | 10/2017 | June et al. |
| 9,840,699 | B2 | 12/2017 | Liu et al. |
| 10,113,163 | B2 | 10/2018 | Liu et al. |
| 10,167,457 | B2 | 1/2019 | Liu et al. |
| 10,465,176 | B2 | 11/2019 | Liu et al. |
| 10,501,519 | B2 | 12/2019 | June et al. |
| 10,526,401 | B2 | 1/2020 | Muir et al. |
| 10,682,410 | B2 | 6/2020 | Liu et al. |
| 10,745,677 | B2 | 8/2020 | Maianti et al. |
| 10,912,833 | B2 | 2/2021 | Liu et al. |
| 10,947,530 | B2 | 3/2021 | Liu et al. |
| 10,968,426 | B2 | 4/2021 | Meissner |
| 11,053,481 | B2 | 7/2021 | Liu et al. |
| 11,090,336 | B2 | 8/2021 | Posey et al. |
| 11,124,782 | B2 | 9/2021 | Liu et al. |

(Continued)

FOREIGN PATENT DOCUMENTS

| | | |
|---|---|---|
| CN | 103088008 A | 5/2013 |
| CN | 105934516 A | 9/2016 |

(Continued)

OTHER PUBLICATIONS

Soltenborn et al. 2018, Novel approach for depletion of TCRab+ and CD45RA+ cells from apheresis products products using the CliniMACS Prodigy, Cytotherapy, vol. 20, Issue 5, S119 (Year: 2018).*

(Continued)

*Primary Examiner* — Taeyoon Kim
(74) *Attorney, Agent, or Firm* — Greenberg Traurig, LLP; Melissa Hunter-Ensor; Nicholas R. Ballor

(57) ABSTRACT

As described below, the present invention features genetically modified immune cells having enhanced anti-neoplasia activity, resistance to immune suppression, and decreased risk of eliciting a graft versus host reaction, or a combination thereof. The present invention also features methods for producing and using these modified immune effector cells.

12 Claims, 67 Drawing Sheets
Specification includes a Sequence Listing.

(56) References Cited

U.S. PATENT DOCUMENTS

| | | |
|---|---|---|
| 11,142,550 B2 | 10/2021 | Muir et al. |
| 11,142,760 B2 | 10/2021 | Slaymaker et al. |
| 11,155,803 B2 | 10/2021 | Gaudelli et al. |
| 11,193,123 B2 | 12/2021 | Halperin |
| 11,214,780 B2 | 1/2022 | Liu et al. |
| 11,268,082 B2 | 3/2022 | Liu et al. |
| 11,306,324 B2 | 4/2022 | Liu et al. |
| 11,319,532 B2 | 5/2022 | Liu et al. |
| 11,344,609 B2 | 5/2022 | Slaymaker et al. |
| 11,479,767 B2 | 10/2022 | Smith et al. |
| 11,542,496 B2 | 1/2023 | Liu et al. |
| 11,732,274 B2 | 8/2023 | Liu et al. |
| 11,866,727 B2 | 1/2024 | Cowan et al. |
| 12,129,478 B1 | 10/2024 | Chen et al. |
| 12,241,096 B2 | 3/2025 | Joung et al. |
| 2004/0003420 A1 | 1/2004 | Kuhn et al. |
| 2004/0115184 A1 | 6/2004 | Smith et al. |
| 2005/0222030 A1 | 10/2005 | Allison |
| 2011/0104787 A1 | 5/2011 | Church et al. |
| 2013/0109048 A1 | 5/2013 | Giugliano et al. |
| 2014/0068797 A1 | 3/2014 | Doudna et al. |
| 2014/0186958 A1 | 7/2014 | Zhang et al. |
| 2014/0273226 A1 | 9/2014 | Wu |
| 2014/0273230 A1 | 9/2014 | Chen et al. |
| 2014/0356956 A1 | 12/2014 | Church et al. |
| 2014/0370045 A1 | 12/2014 | June et al. |
| 2015/0056225 A1 | 2/2015 | Russell |
| 2015/0071903 A1 | 3/2015 | Liu et al. |
| 2015/0165054 A1 | 6/2015 | Liu et al. |
| 2015/0166980 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0344549 A1 | 12/2015 | Muir et al. |
| 2016/0046961 A1 | 2/2016 | Jinek et al. |
| 2016/0200779 A1 | 7/2016 | Liu et al. |
| 2016/0201089 A1 | 7/2016 | Gersbach et al. |
| 2016/0208243 A1 | 7/2016 | Zhang et al. |
| 2016/0280798 A1 | 9/2016 | Orentas et al. |
| 2016/0289674 A1 | 10/2016 | Bancel |
| 2016/0304846 A1 | 10/2016 | Liu et al. |
| 2017/0020922 A1 | 1/2017 | Wagner et al. |
| 2017/0121693 A1 | 5/2017 | Liu et al. |
| 2017/0209492 A1 | 7/2017 | June et al. |
| 2017/0233703 A1 | 8/2017 | Xie et al. |
| 2017/0275648 A1 | 9/2017 | Barrangou et al. |
| 2017/0327804 A9 | 11/2017 | Joung et al. |
| 2018/0037625 A1 | 2/2018 | June et al. |
| 2018/0073012 A1 | 3/2018 | Liu et al. |
| 2018/0118834 A1 | 5/2018 | Brogdon et al. |
| 2018/0127780 A1 | 5/2018 | Liu et al. |
| 2018/0171298 A1 | 6/2018 | Duchateau et al. |
| 2018/0179503 A1 | 6/2018 | Maianti et al. |
| 2018/0216095 A1 | 8/2018 | Thanos et al. |
| 2018/0237787 A1 | 8/2018 | Maianti et al. |
| 2018/0273601 A1 | 9/2018 | Adusumilli et al. |
| 2018/0298421 A1 | 10/2018 | Carpenter et al. |
| 2018/0312825 A1 | 11/2018 | Liu et al. |
| 2018/0312828 A1 | 11/2018 | Liu et al. |
| 2018/0312848 A1 | 11/2018 | Zhao et al. |
| 2018/0320163 A1 | 11/2018 | Koonin et al. |
| 2019/0002875 A1 | 1/2019 | Cheng et al. |
| 2019/0010471 A1 | 1/2019 | Zhang et al. |
| 2019/0010481 A1 | 1/2019 | Joung et al. |
| 2019/0093099 A1 | 3/2019 | Liu et al. |
| 2019/0183932 A1 | 6/2019 | MacKall et al. |
| 2019/0192691 A1 | 6/2019 | Barrett |
| 2019/0225955 A1 | 7/2019 | Liu et al. |
| 2019/0345217 A1 | 11/2019 | Ma et al. |
| 2019/0352369 A1 | 11/2019 | June et al. |
| 2019/0352370 A1 | 11/2019 | Bachmann et al. |
| 2019/0367891 A1 | 12/2019 | Liu et al. |
| 2019/0381154 A1 | 12/2019 | Russell |
| 2019/0389928 A1 | 12/2019 | Posey et al. |
| 2020/0000937 A1 | 1/2020 | DiPersio et al. |
| 2020/0063127 A1 | 2/2020 | Lu et al. |
| 2020/0171135 A1 | 6/2020 | Lanier |
| 2020/0190493 A1 | 6/2020 | Liu et al. |
| 2020/0306304 A1 | 10/2020 | Posey et al. |
| 2020/0308571 A1 | 10/2020 | Joung et al. |
| 2020/0370013 A1 | 11/2020 | Posey et al. |
| 2020/0399619 A1 | 12/2020 | Maianti et al. |
| 2021/0032363 A1 | 2/2021 | Lynn et al. |
| 2021/0032661 A1 | 2/2021 | Powell et al. |
| 2021/0060071 A1 | 3/2021 | Posey et al. |
| 2021/0137979 A1 | 5/2021 | Monje-Deisseroth et al. |
| 2021/0171602 A1 | 6/2021 | MacKall et al. |
| 2021/0230246 A1 | 7/2021 | Posey et al. |
| 2021/0252118 A1 | 8/2021 | Slaymaker et al. |
| 2021/0317440 A1 | 10/2021 | Liu et al. |
| 2021/0371858 A1 | 12/2021 | Evans et al. |
| 2021/0380955 A1 | 12/2021 | Bryson et al. |
| 2022/0047637 A1 | 2/2022 | Lamothe-Dreuzy et al. |
| 2022/0098572 A1 | 3/2022 | Slaymaker et al. |
| 2022/0119785 A1 | 4/2022 | Liu et al. |
| 2022/0127594 A1 | 4/2022 | Gaudelli et al. |
| 2022/0133790 A1 | 5/2022 | Gehrke et al. |
| 2022/0136012 A1 | 5/2022 | Gaudelli et al. |
| 2022/0169998 A1 | 6/2022 | Joung et al. |
| 2022/0170027 A1 | 6/2022 | Gaudelli et al. |
| 2022/0220462 A1 | 7/2022 | Liu et al. |
| 2022/0290115 A1 | 9/2022 | Liu et al. |
| 2022/0290134 A1 | 9/2022 | Jin et al. |
| 2022/0290164 A1 | 9/2022 | Ran et al. |
| 2022/0307003 A1 | 9/2022 | Liu |
| 2022/0387622 A1 | 12/2022 | Gehrke et al. |
| 2023/0021636 A1 | 1/2023 | Gehrke et al. |
| 2023/0075877 A1 | 3/2023 | Gaudelli et al. |
| 2023/0080198 A1 | 3/2023 | Gaudelli et al. |
| 2023/0101597 A1 | 3/2023 | Gaudelli et al. |
| 2023/0108687 A1 | 4/2023 | Liu et al. |
| 2023/0140953 A1 | 5/2023 | Slaymaker et al. |
| 2023/0159956 A1 | 5/2023 | Bryson et al. |
| 2023/0212575 A1 | 7/2023 | Odate et al. |
| 2023/0348883 A1 | 11/2023 | Liu et al. |
| 2023/0383277 A1 | 11/2023 | Cafferty et al. |
| 2023/0407277 A1 | 12/2023 | Joung et al. |
| 2024/0033290 A1* | 2/2024 | Lydeard ................. A61K 35/17 |
| 2024/0132867 A1 | 4/2024 | Gaudelli et al. |
| 2024/0287453 A1 | 8/2024 | Maldini et al. |
| 2024/0325533 A1 | 10/2024 | Murray et al. |
| 2025/0090585 A1 | 3/2025 | Messana et al. |

FOREIGN PATENT DOCUMENTS

| | | |
|---|---|---|
| CN | 106061510 A | 10/2016 |
| CN | 106103475 A | 11/2016 |
| CN | 106916852 A | 7/2017 |
| CN | 107043779 A | 8/2017 |
| CN | 107075483 A | 8/2017 |
| CN | 107109413 A | 8/2017 |
| CN | 107206024 A | 9/2017 |
| CN | 107249606 A | 10/2017 |
| CN | 107532161 A | 1/2018 |
| CN | 108064282 A | 5/2018 |
| CN | 108290933 A | 7/2018 |
| CN | 108513575 A | 9/2018 |
| CN | 108699116 A | 10/2018 |
| CN | 108753823 A | 11/2018 |
| CN | 108949825 A | 12/2018 |
| CN | 109295186 A | 2/2019 |
| CN | 109328231 A | 2/2019 |
| CN | 109957569 A | 7/2019 |
| CN | 109996811 A | 7/2019 |
| CN | 110214180 A | 9/2019 |
| CN | 110214183 A | 9/2019 |
| CN | 110268050 A | 9/2019 |
| CN | 110616189 A | 12/2019 |
| EP | 2877490 B1 | 9/2018 |
| EP | 3956349 A1 | 2/2022 |
| JP | 2017500035 A | 1/2017 |
| JP | 2017508468 A | 3/2017 |
| JP | 2018500006 A | 1/2018 |
| JP | 2018536436 A | 12/2018 |

(56) References Cited

FOREIGN PATENT DOCUMENTS

| | | | |
|---|---|---|---|
| JP | 6629734 | B2 | 1/2020 |
| KR | 20160050069 | A | 5/2016 |
| WO | 1997025416 | A2 | 7/1997 |
| WO | 2001038547 | A2 | 5/2001 |
| WO | 2002068676 | A2 | 9/2002 |
| WO | 2002103028 | A2 | 12/2002 |
| WO | 2010132092 | A2 | 11/2010 |
| WO | 2011075627 | A1 | 6/2011 |
| WO | 2013045632 | A1 | 4/2013 |
| WO | 2013126729 | A1 | 8/2013 |
| WO | 2013176772 | A1 | 11/2013 |
| WO | 2013188037 | A2 | 12/2013 |
| WO | 2014004336 | A2 | 1/2014 |
| WO | 2014089290 | A1 | 6/2014 |
| WO | 2014184143 | A1 | 11/2014 |
| WO | 2014184741 | A1 | 11/2014 |
| WO | 2014186686 | A2 | 11/2014 |
| WO | 2015006294 | A2 | 1/2015 |
| WO | 2015006498 | A2 | 1/2015 |
| WO | 2015021426 | A1 | 2/2015 |
| WO | 2015069922 | A2 | 5/2015 |
| WO | 2015089277 | A1 | 6/2015 |
| WO | 2015089406 | A1 | 6/2015 |
| WO | 2015090230 | A1 | 6/2015 |
| WO | 2015092024 | A2 | 6/2015 |
| WO | 2015133554 | A1 | 9/2015 |
| WO | 2015142675 | A2 | 9/2015 |
| WO | 2015191693 | A2 | 12/2015 |
| WO | 2016011210 | A2 | 1/2016 |
| WO | 2016016343 | A1 | 2/2016 |
| WO | 2016019300 | A1 | 2/2016 |
| WO | 2016061368 | A1 | 4/2016 |
| WO | 2016069910 | A1 | 5/2016 |
| WO | 2016072399 | A1 | 5/2016 |
| WO | 2016073649 | A1 | 5/2016 |
| WO | 2016075612 | A1 | 5/2016 |
| WO | 2016094304 | A2 | 6/2016 |
| WO | 2016115482 | A1 | 7/2016 |
| WO | 2016138038 | A1 | 9/2016 |
| WO | 2016142532 | A2 | 9/2016 |
| WO | 2016160721 | A1 | 10/2016 |
| WO | 2016172727 | A1 | 10/2016 |
| WO | 2016183438 | A1 | 11/2016 |
| WO | 2016196308 | A1 | 12/2016 |
| WO | 2016196388 | A1 | 12/2016 |
| WO | 2016205711 | A1 | 12/2016 |
| WO | 2016205759 | A1 | 12/2016 |
| WO | 2017011721 | A1 | 1/2017 |
| WO | 2017048969 | A1 | 3/2017 |
| WO | 2017049166 | A1 | 3/2017 |
| WO | 2017070632 | A2 | 4/2017 |
| WO | 2017070633 | A2 | 4/2017 |
| WO | 2017077386 | A1 | 5/2017 |
| WO | 2017079703 | A1 | 5/2017 |
| WO | 2017079705 | A1 | 5/2017 |
| WO | 2017093804 | A2 | 6/2017 |
| WO | 2017132580 | A2 | 8/2017 |
| WO | 2017152015 | A1 | 9/2017 |
| WO | 2017165862 | A1 | 9/2017 |
| WO | 2017173054 | A1 | 10/2017 |
| WO | 2017180993 | A1 | 10/2017 |
| WO | 2017184768 | A1 | 10/2017 |
| WO | 2017189308 | A1 | 11/2017 |
| WO | 2018009562 | A1 | 1/2018 |
| WO | 2018020323 | A2 | 2/2018 |
| WO | 2018027036 | A1 | 2/2018 |
| WO | 2018027078 | A1 | 2/2018 |
| WO | 2018035388 | A1 | 2/2018 |
| WO | 2018041973 | A1 | 3/2018 |
| WO | 2018071868 | A1 | 4/2018 |
| WO | 2018085690 | A1 | 5/2018 |
| WO | 2018089664 | A1 | 5/2018 |
| WO | 2018115906 | A1 | 6/2018 |
| WO | 2018119354 | A1 | 6/2018 |
| WO | 2018119359 | A1 | 6/2018 |
| WO | 2018129129 | A1 | 7/2018 |
| WO | 2018140725 | A1 | 8/2018 |
| WO | 2018160768 | A1 | 9/2018 |
| WO | 2018165629 | A1 | 9/2018 |
| WO | 2018165631 | A1 | 9/2018 |
| WO | 2018176009 | A1 | 9/2018 |
| WO | 2018183888 | A2 | 10/2018 |
| WO | 2018204427 | A1 | 11/2018 |
| WO | 2018213708 | A1 | 11/2018 |
| WO | 2018213726 | A1 | 11/2018 |
| WO | 2018218066 | A1 | 11/2018 |
| WO | 2018218188 | A2 | 11/2018 |
| WO | 2018231871 | A1 | 12/2018 |
| WO | 2019005884 | A1 | 1/2019 |
| WO | 2019005886 | A1 | 1/2019 |
| WO | 2019014456 | A1 | 1/2019 |
| WO | 2019014665 | A1 | 1/2019 |
| WO | 2019023680 | A1 | 1/2019 |
| WO | 2019040650 | A1 | 2/2019 |
| WO | 2019071274 | A1 | 4/2019 |
| WO | 2019079347 | A1 | 4/2019 |
| WO | 109706121 | A | 5/2019 |
| WO | 2019118902 | A2 | 6/2019 |
| WO | 2019120310 | A1 | 6/2019 |
| WO | 2019139645 | A2 | 7/2019 |
| WO | 2019161271 | A1 | 8/2019 |
| WO | 2019183000 | A1 | 9/2019 |
| WO | 2019199689 | A1 | 10/2019 |
| WO | 2019210207 | A2 | 10/2019 |
| WO | 2019217941 | A1 | 11/2019 |
| WO | 2019217942 | A1 | 11/2019 |
| WO | 2019217943 | A1 | 11/2019 |
| WO | 2019217944 | A1 | 11/2019 |
| WO | 2019226953 | A1 | 11/2019 |
| WO | 2020010239 | A1 | 1/2020 |
| WO | 2020028823 | A1 | 2/2020 |
| WO | 2020041751 | A1 | 2/2020 |
| WO | 2020051561 | A1 | 3/2020 |
| WO | 2020112870 | A1 | 6/2020 |
| WO | 2020118076 | A1 | 6/2020 |
| WO | 2020132327 | A1 | 6/2020 |
| WO | 2020150534 | A2 | 7/2020 |
| WO | 2020160514 | A1 | 8/2020 |
| WO | 2020160517 | A1 | 8/2020 |
| WO | 2020163396 | A1 | 8/2020 |
| WO | 2020168051 | A1 | 8/2020 |
| WO | 2020168075 | A1 | 8/2020 |
| WO | 2020168088 | A1 | 8/2020 |
| WO | 2020168122 | A1 | 8/2020 |
| WO | 2020168132 | A1 | 8/2020 |
| WO | 2020168133 | A1 | 8/2020 |
| WO | 2020168135 | A1 | 8/2020 |
| WO | 2020168300 | A1 | 8/2020 |
| WO | 2020176897 | A1 | 9/2020 |
| WO | 2020198413 | A1 | 10/2020 |
| WO | 2020214842 | A1 | 10/2020 |
| WO | 2020227446 | A1 | 11/2020 |
| WO | 2020227447 | A1 | 11/2020 |
| WO | 2020236936 | A1 | 11/2020 |
| WO | 2020236964 | A1 | 11/2020 |
| WO | 2020236982 | A1 | 11/2020 |
| WO | 2020243315 | A1 | 12/2020 |
| WO | 2021020884 | A2 | 2/2021 |
| WO | 2021022043 | A2 | 2/2021 |
| WO | 2021041945 | A2 | 3/2021 |
| WO | 2021042062 | A2 | 3/2021 |
| WO | 2021050571 | A1 | 3/2021 |
| WO | 2021055459 | A1 | 3/2021 |
| WO | 2021062227 | A2 | 4/2021 |
| WO | 2021072250 | A1 | 4/2021 |
| WO | 2021081264 | A1 | 4/2021 |
| WO | 2021087182 | A1 | 5/2021 |
| WO | 2021087356 | A1 | 5/2021 |
| WO | 2021097521 | A1 | 5/2021 |
| WO | 2021108717 | A2 | 6/2021 |
| WO | 2021127594 | A1 | 6/2021 |
| WO | 2021158921 | A2 | 8/2021 |
| WO | 2021163616 | A1 | 8/2021 |
| WO | 2021175288 | A1 | 9/2021 |

(56) References Cited

FOREIGN PATENT DOCUMENTS

| | | | |
|---|---|---|---|
| WO | 2021207651 | A2 | 10/2021 |
| WO | 2022008935 | A1 | 1/2022 |
| WO | 2022015969 | A1 | 1/2022 |
| WO | 2022056254 | A2 | 3/2022 |
| WO | 2022056324 | A1 | 3/2022 |
| WO | 2022067089 | A1 | 3/2022 |
| WO | 2022081890 | A1 | 4/2022 |
| WO | 2022112404 | A1 | 6/2022 |
| WO | 2022148955 | A1 | 7/2022 |
| WO | 2022150367 | A1 | 7/2022 |
| WO | 2022150372 | A1 | 7/2022 |
| WO | 2022150706 | A2 | 7/2022 |
| WO | 2022204574 | A1 | 9/2022 |
| WO | 2022272292 | A2 | 12/2022 |
| WO | 2023279118 | A2 | 1/2023 |
| WO | 2023288304 | A2 | 1/2023 |
| WO | 2023023515 | A1 | 2/2023 |
| WO | 2023034959 | A2 | 3/2023 |
| WO | 2023047338 | A1 | 3/2023 |
| WO | 2023049299 | A2 | 3/2023 |
| WO | 2023108107 | A2 | 6/2023 |
| WO | 2023125814 | A1 | 7/2023 |
| WO | 2023155901 | A1 | 8/2023 |
| WO | 2023193536 | A1 | 10/2023 |
| WO | 2023227669 | A2 | 11/2023 |
| WO | 2023235813 | A2 | 12/2023 |
| WO | 2023247753 | A1 | 12/2023 |
| WO | 2023248110 | A1 | 12/2023 |
| WO | 2024006772 | A2 | 1/2024 |
| WO | 2024040083 | A1 | 2/2024 |
| WO | 2024063273 | A1 | 3/2024 |
| WO | 2024073385 | A2 | 6/2024 |
| WO | 2024179426 | A2 | 9/2024 |
| WO | 2024226156 | A1 | 10/2024 |
| WO | 2024227047 | A2 | 10/2024 |
| WO | 2024259364 | A2 | 12/2024 |

OTHER PUBLICATIONS

International Search Report and Written Opinion in corresponding International Patent Application No. PCT/US2020/052822 mailed Mar. 18, 2021 (12 pages).

Kim et al., "Highly efficient RNA-guided genome editing in human cells via delivery of purified Cas9 ribonucleoproteins," Genome Research, 2014, vol. 24, pp. 1012-1019.

Kim et al., "Rescue of high-specificity Cas9 variants using sgRNAs with matched 5' nucleotides," Genome Biology, 2017, vol. 18, No. 218, pp. 1-6.

Kim et al., "Transcriptional Repression by Zinc Finger Peptides," The Journal of Biological Chemistry, Nov. 21, 1997, vol. 272, No. 47, pp. 29795-29800.

Kim et al., "Structural and Kinetic Characterization of Escherichia Coli TadA, the Wobble-Specific TRNA Deaminase," Biochemistry, 2006, vol. 45, No. 20, pp. 6407-6416.

Kitamura et al., "Uracil DNA Glycosylase Counteracts APOBEC3G-Induced Hypermutation of Hepatitis B Viral Genomes: Excision Repair of Covalently Closed Circular DNA," PLOS Pathogens, May 2013, vol. 9, No. 5, e1003361, pp. 1-14.

Kleinstiver et al., "Broadening Staphylococcus aureus Cas9 Targeting Range by Modifying PAM Recognition," Nature Biotechnology, Dec. 2015, vol. 33, No. 12, pp. 1293-1298.

Kleinstiver et al., "Engineered CRISPR-Cas9 nucleases with altered PAM specificities," Nature, Jul. 23, 2015, vol. 523, pp. 481-485.

Kleinstiver et al., "High-fidelity CRISPR-Cas9 variants with undetectable genome-wide off-targets," Molecular Therapy, Jan. 28, 2016, vol. 529, No. 75187, pp. 490-495.

Koblan et al., "Improving cytidine and adenine base editors by expression optimization and ancestral reconstruction," Nature Biotechnology, 2018, pp. 1-4.

Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.

Komor et al., "Programmable editing of a target base in genomic DNA without double-stranded DNA cleavage," Nature, May 19, 2016, vol. 533, pp. 420-424.

Kundu et al., "Leucine to proline substitution by SNP at position 197 in Caspase-9 gene expression leads to neuroblastoma: a bioinformatics analysis," 3 Biotech, 2013, vol. 3, pp. 225-234.

Lapinaite et al., "DNA capture by a CRISPR-Cas9-guided adenine base editor," Science, Jul. 31, 2020, vol. 369, No. 6503, pp. 566-571.

Lau et al., "Molecular basis for discriminating between normal and damaged bases by the human alkyladenine glycosylase, AAG," Proceedings of the National Academy of Sciences of the United States of America, Dec. 5, 2000, vol. 97, No. 25, pp. 13573-13578.

Lazar et al., "Transforming Growth Factor α: Mutation of Aspartic Acid 47 and Leucine 48 Results in Different Biological Activities," Molecular and Cellular Biology, Mar. 1988, vol. 8, No. 3, pp. 1247-1252.

Lee et al., "CRISPR-Pass: Gene Rescue of Nonsense Mutations Using Adenine Base Editors," Molecular Therapy, Aug. 2019, vol. 27, No. 8, pp. 1364-1371.

Lee et al., "Cytosine but not adenine base editor generates mutations in mice," bioRxiv, 2019, pp. 1-24.

Lee et al., "PIK3CA gene is frequently mutated in breast carcinomas and hepatocellular carcinomas," Oncogene, 2005, vol. 24, pp. 1477-1480.

Leibundgut-Landmann et al., "Mini-review: Specificity and expression of CIITA, the master regulator of MHC class II genes," European Journal of Immunology, 2004, vol. 34, pp. 1513-1525.

Lenk et al., "Pathogenic Mechanism of the FIG4 Mutation Responsible for Charcot-Marie-Tooth Disease CMT4J," Plos Genetics, Jun. 2011, vol. 7, No. 6, e1002104, pp. 1-13.

Li et al., "Current Approaches for Engineering Proteins with Diverse Biological Properties," Bio-Applications of Nanoparticles, 2007, pp. 1-16.

Liu et al., "C2c1-sgRNA Complex Structure Reveals RNA-Guided DNA Cleavage Mechanism," Molecular Cell, Jan. 19, 2017, vol. 65, pp. 310-322.

Lyons et al., "Efficient Recognition of an Unpaired Lesion by a DNA Repair Glycosylase," Journal of the American Chemical Society, 2009, vol. 131, No. 49, pp. 17742-17743.

Ma et al., "Targeted AID-mediated mutagenesis (TAM) enables efficient genomic diversification in mammalian cells," Nature Methods, Dec. 2016, vol. 13, No. 12, pp. 1029-1035.

Majzner et al., "Tumor Antigen Escape from CAR T-cell Therapy," Cancer Discovery, Oct. 2018, vol. 8, No. 10, pp. 1219-1226.

Makarova et al., "Classification and Nomenclature of CRISPR-Cas Systems: Where from Here?," The CRISPR Journal, 2018, vol. 1, No. 5, pp. 325-336.

Mali et al., "Cas9 as a versatile tool for engineering biology," Nature Methods, Oct. 2013, vol. 10, No. 10, pp. 957-963.

Mali et al., "CAS9 transcriptional activators for target specificity screening and paired nickases for cooperative genome engineering," Nature Biotechnology, 2013, pp. 1-6.

Mccann et al., "MagnEdit—interacting factors that recruit DNA-editing enzymes to single base targets," Life Science Alliance, 2020, vol. 3, No. 4, e201900606, pp. 1-9.

Mejstrikova et al., "CD19-negative relapse of pediatric B-cell precursor acute lymphoblastic leukemia following plinatumomab treatment," Blood Cancer Journal, 2017, vol. 7, No. 659, pp. 1-5.

Mikami et al., "Comparison of CRISPR/Cas9 expression constructs for efficient targeted mutagenesis in rice," Plant Molecular Biology, 2015, vol. 88, pp. 561-572.

Miller et al., "Continuous evolution of SpCas9 variants compatible with non-G PAMs," Nature Biotechnology, Apr. 2020, vol. 38, No. 4, pp. 471-481.

Mohamad et al., "Human hemoglobin G-Makassar variant masquerading as sickle cell anemia," Hematology Reports, 2018, vol. 10, No. 7210, pp. 92-95.

Mullins et al., "Transgenesis in Nonmurine Species," Hypertension, 1993, vol. 22, pp. 630-633.

(56) References Cited

OTHER PUBLICATIONS

Navaratnam et al., "An Overview of Cytidine Deaminases," International Journal of Hematology, 2006, vol. 83, pp. 195-200.

Nishida et al., "Targeted nucleotide editing using hybrid prokaryotic and vertebrate adaptive immune systems," Science, Sep. 16, 2016, vol. 353, No. 6305, pp. 1248-aaf8729-8.

Nishimasu et al., "Engineered CRISPR-Cas9 nuclease with expanded targeting space," Science, 2018, vol. 361, pp. 1259-1262.

Okumura et al., "Evolutionary paths of streptococcal and staphylococcal superantigens," BMC Genomics, 2012, vol. 13, No. 404, pp. 1-16.

Parr et al., "N1-Methylpseudouridine substitution enhances the performance of synthetic mRNA switches in cells," Nucleic Acids Research, 2020, vol. 48, No. 6, e35, pp. 1-9.

Pausch et al., "CRISPR-CasΦ from huge phages is a hypercompact genome editor," Science, Jul. 17, 2020, vol. 369, No. 6501, pp. 333-337.

Phillips, Anthony J., "The challenge of gene therapy and DNA delivery," Journal of Pharmacy and Pharmacology, 2001, vol. 53, pp. 1169-1174.

Poirot et al., "Multiplex Genome-Edited T-cell Manufacturing Platform for "Off-the-Shelf" Adoptive T-cell Immunotherapies," Cancer Research, Sep. 15, 2015, vol. 75, No. 18. pp. 3853-3864.

Poller et al., "A Leucine-to-Proline Substitution Causes a Defective α1-Antichymotrypsin Allele Associated with Familial Obstructive Lung Disease," Genomics, 1993, vol. 17, pp. 740-743.

Putnam et al., "Protein Mimicry of DNA from Crystal Structures of the Uracil-DNA Glycosylase Inhibitor Protein and its Complex with *Escherichia coli* Uracil-DNA Glycosylase," Journal of Molecular Biology, 1999, vol. 287, pp. 331-346.

Qasim et al., "Molecular remission of infant B-ALL after infusion of universal TALEN gene-edited CAR T cells," Science Translational Medicine, Jan. 25, 2017, vol. 9, No. eaaj2013, pp. 1-8.

Qi et al., "Repurposing CRISPR as an RNA-Guided Platform for Sequence-Specific Control of Gene Expression," Cell, Feb. 28, 2013, vol. 152, pp. 1173-1183.

Ran et al., "In vivo genome editing using *Staphylococcus aureus* Cas9," Nature, Apr. 9, 2015, vol. 520, No. 7546, pp. 186-191.

Rees et al., "Analysis and minimization of cellular RNA editing by DNA adenine base editors," Science Advances, May 8, 2019, vol. 5, No. eaax5717, pp. 1-10.

Rees et al., "Base editing: precision chemistry on the genome and transcriptome of living cells," Nature Reviews Genetics, Dec. 2018, vol. 19, No. 12, pp. 770-788.

Rees et al., "Improving the DNA specificity and applicability of base editing through protein engineering and protein delivery," Nature Communications, 2017, vol. 8, No. 15790, pp. 1-10.

Aratyn-Schaus et al., "[589] Base-Editing as a Therapeutic Approach for the Direct Correction of Disease-Causing Mutations Underlying Glycogen Storage Disease Type IA," AASLD Abstracts (Poster), Hepatology, Oct. 2020, vol. 72, No. Suppl. 1, pp. 354A-355A.

Azad et al., "Site-directed RNA editing by adenosine deaminase acting on RNA for correction of the genetic code in gene therapy," Gene Therapy, 2017, vol. 24, pp. 779-786.

Baligar et al., "Bone Marrow Stem Cell Therapy Partially Ameliorates Pathological Consequences in Livers of Mice Expressing Mutant Human α1-Antitrypsin," Hepatology, Apr. 2017, vol. 65, No. 4, pp. 1319-1335.

Baños-Sanz et al., "Crystal structure and functional insights into uracil-DNA glycosylase inhibition by phage φ29 DNA mimic protein p56," Nucleic Acids Research, 2013, vol. 41, No. 13, pp. 6761-6773.

BC021560, European Nucleotide Archive Accession No. BC021560, *Homo sapiens* deleted in bladder cancer 1, mRNA (cDNA clone), complete eds., Jan. 22, 2002 [online]. [Retrieved on Oct. 2, 2023]. Retrieved from the Internet <URL: https://www.ebi.ac.uk/ena/browser/view/BC021560> Entire document.

Bjursell et al., "Therapeutic Genome Editing With CRISPR/Cas9 in a Humanized Mouse Model Ameliorates α1-antitrypsin Deficiency Phenotype," EBioMedicine, 2018, vol. 29, pp. 104-111.

Canver et al., "Customizing the genome as therapy for the β-hemoglobinopathies," Blood, May 26, 2016, vol. 127, No. 21, pp. 2536-2545.

Cartegni et al., "Determinants of Exon 7 Splicing in the Spinal Muscular Atrophy Genes, SMN1 and SMN2," The American Journal of Human Genetics, Jan. 2006, vol. 78, pp. 63-77.

Chadwick et al., "In Vivo Base Editing of PCSK9 (Proprotein Convertase Subtilisin/Kexin Type 9) as a Therapeutic Alternative to Genome Editing," Arteriosclerosis, Thrombosis, and Vascular Biology, Sep. 2017, vol. 37, Article No. 9, pp. 1741-1747.

Chang et al., "Degradation of survival motor neuron (SMN) protein is mediated via the ubiquitin/proteasome pathway," Neurochemistry International, 2004, vol. 45, pp. 1107-1112.

Charpentier et al. "Rewriting a genome", Nature, Mar. 2013, vol. 495, No. 7439, pp. 50-51.

Chen et al. "Targeting genomic rearrangements in tumor cells through Cas9-mediated insertion of a suicide gene." Nature Biotechnology, Jun. 2017, vol. 35, No. 6, pp. 543-552.

Cho et al., "A degron created by SMN2 exon 7 skipping is a principal contributor to spinal muscular atrophy severity," Genes & Development, 2010, vol. 24, pp. 438-442.

Cooper et al., "Chimeric antigen 1-5 receptor T cells (CAR-T) for the treatment of T-cell malignancies", Best Practice & Research Clinical Haematology, vol. 32, No. 4, Oct. 2019.

Corcia et al., "The importance of the SMN genes in the genetics of sporadic ALS," Amyotrophic Lateral Sclerosis, 2009, vol. 10, pp. 436-440.

Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).

Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.

De Souza. "Primer: genome editing with engineered nucleases." Nature Methods, vol. 9, No. 1, Jan. 2012, pp. 27-27.

Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).

D'Ydewalle et al., "The Antisense Transcript SMN-AS1 Regulates SMN Expression and Is a Novel Therapeutic Target for Spinal Muscular Atrophy," Neuron, Jan. 4, 2017, vol. 93, pp. 63-79.

Fagagna et al., "The Gam protein of bacteriophage Mu is an orthologue of eukaryotic Ku," EMBO reports, 2003, vol. 4, No. 1, pp. 47-52.

Fitzhugh et al., "At least 20% donor myeloid chimerism is necessary to reverse the sickle phenotype after allogeneic HSCT," Blood, Oct. 26, 2017, vol. 130, No. 17, pp. 1946-1948.

Gao et al. Inflammation negatively regulates FOXP3 and regulatory T-cell function via DBC1. Proceedings of the National Academy of Sciences of the United States of America, Jun. 9, 2015, vol. 112, No. 25, E3246-E3254.

Gaudelli et al., "Programmable Base Editing of A•T to G•C in Genomic DNA without DNA Cleavage," Nature, Nov. 23, 2017, vol. 551, pp. 464-471 and pp. 472-487 containing Methods, Figures, Life Sciences Reporting Summary and Corrections & Amendments (37 total pages).

GenBank Accession No. AIT42264.1, downloaded Jan. 9, 2024.

GenBank Accession No. AKA60242.1, downloaded Jan. 9, 2024.

GenBank Accession No. AKQ21048.1, downloaded Jan. 9, 2024.

GenBank Accession No. AKS40380.1, downloaded Jan. 9, 2024.

GenBank Accession No. CTS26096.1, downloaded Apr. 9, 2024.

GenBank Locus No. LC169509.1, downloaded Aug. 10, 2023.

GenBank NCBI Reference Sequence No. NM_000295.4, downloaded Aug. 23, 2023.

GenBank Protein No. 4UN5_B, downloaded Jan. 9, 2024.

Geneseq, "*Streptococcus pyogenes* Cas9 protein", XP002808136, retrieved from EBI accession No. GSP: BIR16744 Database accession No. BIR16744 sequence—& DATBSE Geneseq [Online], Jan. 21, 2021.

(56)         References Cited

OTHER PUBLICATIONS

Geneseq, "*Streptococcus pyogenes* Cas9 protein", XP002808135, retrieved from EBI accession No. GSP: BIR16747 Database accession No. BIR16747 sequence—& DATBSE Geneseq [Online], Jan. 21, 2021.

Geneseq, "Adenine deaminase polypeptide SEQ: 49.", XP002808137, retrieved from EBI accession No. GSP: BJG44493 Database accession No. BJG44493 sequence—& DATBSE Geneseq [Online], Jun. 10, 2021.

Greene et al., "Alpha-1 Antitrypsin Deficiency: Recent Developments in Gene Therapy Research," Gene Therapy Application, 2011, vol. 25, pp. 449-460.

Grimm et al., In vitro and In vivo Gene Therapy Vector Evolution via Multispecies Interbreeding and Retargeting of Adeno-Associated Viruses. J. Virol., 2008, vol. 82, p. 5887-5911.

Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).

Hess et al., "Methods and Applications of CRISPR-Mediated Base Editing in Eukaryotic Genomes," Molecular Cell, Oct. 5, 2017, vol. 68, pp. 26-43.

Jeong et al., "Measurement of deoxyinosine adduct: Can it be a reliable tool to assess oxidative or nitrosative DNA damage?," Toxicology Letters, 2012, vol. 214, pp. 226-233.

Jha et al., "Single amino acid substitutions in recombinant plant-derived human α1-proteinase inhibitor confer enhanced stability and functional efficacy," Biochimica et Biophysica Acta, 2014, vol. 1840, pp. 416-427.

Kim et al., "Highly efficient RNA-guided base editing in mouse embryos," Nature Biotechnology, 2017, pp. 1-4.

Kim et al., "Increasing the genome-targeting scope and precision of base editing with engineered Cas9-cytidine deaminase fusions," Nature Biotechnology, Apr. 2017, vol. 35, Article No. 4, pp. 371-376 and pp. 7-15 containing Online Methods, Supplementary Material, Acknowledgments, References and Figures (15 total pages).

Kleinstiver et al., "Broadening the targeting range of *Staphylococcus aureus* CRISPR-Cas9 by modifying PAM recognition," Nature Biotechnology, Dec. 2015, vol. 33, No. 12, pp. 1293-1298 and p. 1299 containing Online Methods (7 total pages).

Kleinstiver et al., "Engineered CRISPR-Cas9 nucleases with altered PAM specificities," Nature, Jul. 23, 2015, vol. 523, Article No. 7561, pp. 481-485 and pp. 24-27 containing Figures (27 total pages).

Komor et al., "Programmable Editing of a Target Base in Genomic DNA without Double-Stranded DNA Cleavage," Nature, May 19, 2016, vol. 533, pp. 420-424 and pp. 425-436 containing Methods and Figures (25 total pages).

Le et al., "SMND7, the major product of the centromeric survival motor neuron (SMN2 ) gene, extends survival in mice with spinal muscular atrophy and associates with full-length SMN," Human Molecular Genetics, 2005, vol. 14, No. 6, pp. 845-857.

Lefebvre et al., "Identification and Characterization of a Spinal Muscular Atrophy-Determining Gene," Jan. 13, 1995, vol. 80, pp. 155-165.

Lei et al., "Glucose-6-phosphatase dependent substrate transport in the glycogen storage disease type-1a mouse," Nature Genetics, Jun. 1996, vol. 13, pp. 203-209.

Burstein et al., "New CRISPR-Cas systems from uncultivated microbes," Nature, Feb. 9, 2017, vol. 542, Article No. 7640, pp. 237-241.

Cheng et al., "Cloning, expression and activity identification of human innate immune protein apolipoprotein B mRNA editing enzyme catalytic subunit 3A(APOBEC3A)," Chinese Journal of Cellular and Molecular Immunology, 2017, vol. 33, No. 2, pp. 179-184 [English Abstract].

Eid et al., "CRISPR base editors: genome editing without double-stranded breaks," Biochemical Journal, 2018, vol. 475, pp. 1955-1964.

Ekstrand et al., "Frequent alterations of the PI3K/AKT/mTOR pathways in hereditary nonpolyposis colorectal cancer," Familial Cancer, 2010, vol. 9, pp. 125-129.

Kaya et al., "A bacterial Argonaute with noncanonical guide RNA specificity," Proceedings of the National Academy of Sciences of the United States of America, Apr. 12, 2016, vol. 113, No. 15, pp. 4057-4062.

Komor et al., "CRISPR-Based Technologies for the Manipulation of Eukaryotic Genomes," Cell, Jan. 12, 2017, vol. 168, pp. 20-36.

Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.

Lavergne et al., "Defects in type IIA von Willebrand disease: a cysteine 509 to arginine substitution in the mature von Willebrand factor disrupts a disulphide loop involved in the interaction with platelet glycoprotein Ib-IX," British Journal of Haematology, 1992, vol. 82, pp. 66-72.

Plosky, Brian S., "CRISPR-Mediated Base Editing without DNA Double-Strand Breaks," Molecular Cell, May 19, 2016, vol. 62, pp. 477-478.

UniProt Accession No. A0A5F1IHX6, downloaded Apr. 11, 2023.

UniProt Accession No. A8AD26, downloaded Apr. 11, 2023.

Yan et al., "High-efficiency and multiplex adenine base editing in plants using new TadA variants," Molecular Plant, May 3, 2021, vol. 14, pp. 722-731.

Qianqian, Xiong, "Advances in Diagnosis and Treatment of Glycogen Storage Diseases," Journal of Stroke and Neurological Diseases, 2017, vol. 34, No. 10, pp. 957-960 [English Abstract].

Qing et al., "Research progress on double-stranded RNA-specific adenosine deaminase-DSRAD/ADAR1," Foreign Medical Sciences, 2004, vol. 3, pp. 129-132 [English Abstract Only].

Rajamohan et al., "Current status of drug screening and disease modelling in human pluripotent stem cells," Bioessays, 2012, vol. 35, pp. 281-298.

Ramakrishna et al., "Gene disruption by cell-penetrating peptide-mediated delivery of Cas9 protein and guide RNA," Genome Research, 2014, vol. 24, pp. 1020-1027.

Ranzau et al., "The wild-type tRNA adenosine deaminase enzyme TadA is capable of sequence-specific DNA base editing." Chembiochem, Aug. 2023, vol. 24, No. 16, pp. 1-35.

Ribeiro et al., "Protein Engineering Strategies to Expand CRISPR-Cas9 Applications," Hindawi: International Journal of Genomics, 2018, vol. 2018, Article No. 1652567, pp. 1-12.

Riesenberg et al. "Improved gRNA secondary structures allow editing of target sites resistant to CRISPR-Cas9 cleavage." Nature communications, 2022, vol. 13 No. 1, p. 489.

Rogozin et al. "Evolution and diversification of lamprey antigen receptors: evidence for involvement of an AID-APOBEC family cytosine deaminase," Nature Immunology, Jun. 2007, vol. 8, No. 6, pp. 647-656.

Rölle et al., "Distinct HLA-E Peptide Complexes Modify Antibody-Driven Effector Functions of Adaptive NK Cells," Cell Reports, Aug. 2018, vol. 24, No. 8, pp. 1967-1976.

Ruffolo, et al., "Design of highly functional genome editors by modeling of the universe of CRISPR-Cas Sequences," bioRxiv, posted Apr. 22, 2024, doi: 10.1101/2024.04.22.590591.

Ryu et al., "Adenine base editing in mouse embryos and an adult mouse model of Duchenne muscular dystrophy," Nature Biotechnology, Jun. 2018, vol. 36, No. 6, pp. 536-539.

Sang et al., "A unique uracil-DNA binding protein of the uracil DNA glycosylase superfamily," Nucleic Acids Research, Sep. 30, 2015, vol. 43, No. 17, pp. 8452-8463.

Sangkitporn et al., "Hb G Makassar (Beta 6: Glu→ Ala) in a Thai Family," Journal of the Medical Association of Thailand, May 2002, vol. 85, No. 5, pp. 577-582.

Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.

Shah et al., "Efficient and versatile CRISPR engineering of human neurons in culture to model neurological disorders," Wellcome

(56) References Cited

OTHER PUBLICATIONS

Open Research, Nov. 15, 2016, vol. 1, No. 13, pp. 1-18 and pp. 19-21 containing Open Peer Review (21 total pages).

Shah et al., "MeCP2 mutations: progress towards understanding and treating Rett syndrome," Genome Medicine, 2017, vol. 9, No. 17, pp. 1-4.

Shee et al., "Engineered proteins detect spontaneous DNA breakage in human and bacterial cells," eLife, 2013, vol. 2, No. e01222, pp. 1-25.

Shen et al., "Amelioration of Alpha-1 Antitrypsin Deficiency Diseases with Genome Editing in Transgenic Mice," Human Gene Therapy, 2018, vol. 29, No. 8, pp. 861-873.

Singh et al., "Splicing of a Critical Exon of Human Survival Motor Neuron Is Regulated by a Unique Silencer Element Located in the Last Intron," Molecular and Cellular Biology, Feb. 2006, vol. 26, No. 4, pp. 1333-1346.

Sinnamon et al., "Site-directed RNA repair of endogenous Mecp2 RNA in neurons," Proceedings of the National Academy of Sciences of the United States of America, Oct. 16, 2017, pp. E9395-E9402.

Smith et al., "Efficient and Allele-Specific Genome Editing of Disease Loci in Human iPSCs," Molecular Therapy, Mar. 2015, vol. 23, No. 3, pp. 570-577.

Song et al. "Delivery of CRISPR/Cas systems for cancer gene therapy and immunotherapy." Advanced Drug Delivery Reviews, 2021, vol. 168, pp. 150-180.

Stanton et al. "Systemic administration of novel engineered AAV capsids facilitates enhanced transgene expression in the macaque CNS." Med, 2023, vol. 4. No. 1, pp. 31-50.

Talbot et al., "Spinal muscular atrophy," Journal of Inherited Metabolic Disease, Jun. 2001, vol. 21, No. 2, pp. 189-197 [Abstract Only].

Thorpe et al. "Functional Correction of Episomal Mutations With Short DNA Fragments and RNA-DNA Oligonucleotides." Journal of Gene Medicine, Jan. 2002, vol. 4, No. 1, pp. 195-204.

Tipanee, et al. "Transposons: Moving Forward from Preclinical Studies to Clinical Trials," Human Gene Therapy, Nov. 2017, pp. 1087-1104.

Tsai et al. "Dimeric CRISPR RNA-guided FokI nucleases for highly specific genome editing." Nature Biotechnology, Apr. 2014, vol. 32, No. 6, pp. 569-576.

UniProt Accession No. P51908, Downloaded Jan. 9, 2024.

UniProt Accession No. Q6JC40, Downloaded Nov. 14, 2024.

Valdmanis et al., "Future of rAAV Gene Therapy: Platform for RNAi, Gene Editing, and Beyond," Human Gene Therapy, 2017, vol. 28, No. 4, pp. 361-372.

Wan et al. "Material solutions for delivery of CRISPR/Cas-based genome editing tools: current status and future outlook." Materials Today, Jun. 2019, vol. 26, pp. 40-66.

Webber et al., "Multiplex Human T Cell Engineering without Double-Strand Break Induction Using the Cas9 Base Editor System," Blood, Nov. 29, 2018, vol. 132, Article No. Suppl. 1, p. 3495.

Wei et al., "The "new favorite" of gene editing technology-single base editors," Hereditas, 2017, vol. 39, No. 12, pp. 1115-1121 [English Abstract].

Werder et al., "Adenine base editing reduces misfolded protein accumulation and toxicity in alpha-1 antitrypsin deficient patient iPSC-hepatocytes," Molecular Therapy, Nov. 2021, vol. 29, No. 11, pp. 3219-3229.

Wienert et al., "KLF1 drives the expression of fetal hemoglobin in British HPFH," Blood, Aug. 10, 2017, vol. 130, No. 6, pp. 803-807.

Wirth et al., "Mildly affected patients with spinal muscular atrophy are partially protected by an increased SMN2 copy number," Human Genetics, 2006, vol. 119, pp. 422-428.

Yang et al., "APOBEC: From mutator to editor," Journal of Genetics and Genomics, 2017, vol. 44, pp. 423-437.

Yong et al., "Base Editing and its Applications in Gene Therapy," Chinese Journal of Otology, 2018, vol. 16, No. 2, pp. 150-154 [English Abstract].

Yu et al., "Cutting Edge: Single-Chain Trimers of MHC Class I Molecules Form Stable Structures That Potently Stimulate Antigen-Specific T Cells and B Cells," The Journal of Immunology, 2002, vol. 168, pp. 3145-3149.

Yuliang et al., "Diagnosis and treatment of α1-antitrypsin deficiency," Practical Clinical Medicine, 2017, vol. 2, pp. 104-107 [English Abstract Only].

Zhang et al., "Genetic abrogation of immune checkpoints in antigen-specific cytotoxic T-lymphocyte as a potential alternative to blockade immunotherapy," Scientific Reports, 2018, vol. 8, No. 5549, pp. 1-13.

Zhang et al., "Progress in base editing technology based on CRISPR/Cas9 system and its application in medical research," Chinese Journal of Pharmacology and Toxicology, Jul. 2018, vol. 32, No. 7, pp. 507-514 [English Abstract].

Zhou et al., "Cas12a variants designed for lower genome-wide off-target effect through stringent PAM recognition", Molecular Therapy, Jan. 2022, vol. 30, No. 1 , pp. 1-12.

Zong et al., "Precise base editing in rice, wheat and maize with a Cas9-cytidine deaminase fusion," Nature Biotechnology, 2017, pp. 1-4.

Glick, Meir. "Novel CD8 T Cell Antagonists Based on 2-Microglobulin*" 20840-20846. The Journal of Biological Chemistry. Web. Mar. 25, 2002; p. 20844, 2nd column, 3rd-4th paragraphs; DOI: 10.1074/jbc.M201819200.

Cooper et al., "An "off-the-shelf" fratricide-resistant CAR-T for the treatment of T cell hematologic malignancies", Blood Cancer Journal, vol. 32, No. 9, Feb. 20, 2018, pp. 1970-1983.

Edwards et al., "Base Editors Generate Allogeneic CAR-T Cells with No Detectable Genomic Rearrangements and Reduced Genotoxicity", Molecular Therapy; 22nd Annual Meeting of the American-Society-of-Gene-and-Cell-Therapy (ASGCT), Apr. 29-May 2, 2019, vol. 27, No. 4, Suppl. 1, Apr. 22, 2019, p. 74.

Qasim, "Allogeneic CART cell therapies for leukemia", American Journal of Hematology, vol. 94, Feb. 1, 2019, pp. S50-S54.

Li et al. "Base editing with a Cpf1-cytidine deaminase fusion." Nature biotechnology, 2018, vol. 36, No. 4, pp. 324-327.

Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].

Liu et al., "CRISPR-Cas9-mediated multiplex gene editing in CAR-T cells," Cell Research, Jan. 2017, vol. 27, No. 1, pp. 154-157.

Liu et al., "Research Progress of Base Editing System," World Sci-Tech R&D, Dec. 2017, vol. 39, No. 6, pp. 457-462 [English Abstract].

Liu et al., "Supplementary information, Figure S1. Multiplex gene editing mediated by CRISPR-Cas9 in primary T cells," Cell Research, Jan. 2017, pp. 1-3 <https://static-content.springer.com/esm/art%3A10.1038%2Fcr.2016.142/MediaObjects/41422_2017_BFcr2016142_MOESM20_ESM.pdf>.

Liu, et al. "Crossing the blood-brain barrier with AAV vectors," Metabolic Brain Disease, 2021, vol. 36, pp. 45-52.

Lorson et al., "A single nucleotide in the SMN gene regulates splicing and is responsible for spinal muscular atrophy," Proceedings of the National Academy of Sciences of the United States of America, May 1999, vol. 96, pp. 6307-6311.

Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.

Maeder et al. "CRISPR RNA-guided activation of endogenous human genes", Nature Methods, Oct. 2013, vol. 10, No. 10, pp. 977-979.

Mariani et al. "Species-specific exclusion of APOBEC3G from HIV-1 virions by Vif." Cell, 2003, vol. 114, No. 1, 21-31.

Micozzi et al., "Human cytidine deaminase: A biochemical characterization of its naturally occurring variants," International Journal of Biological Macromolecules, Feb. 2014, vol. 63, pp. 64-74 and pp. 75-91 containing Acknowledgments, Abbreviations, References, and Figures (28 total pages).

(56) References Cited

OTHER PUBLICATIONS

Monani et al., "A single nucleotide difference that alters splicing patterns distinguishes the SMA gene SMN1 from the copy gene SMN2," Human Molecular Genetics, 1999, vol. 8, No. 7, pp. 1177-1183.

Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.

Musallam et al., "Fetal hemoglobin levels and morbidity in untransfused patients with β-thalassemia intermedia," Blood, Jan. 12, 2012, vol. 119, No. 2, pp. 364-367.

NCBI Reference Protein No. Q694B3.2, downloaded Apr. 8, 2024.

NCBI Reference Sequence No. NC_000001.11, downloaded Jan. 9, 2024.

NCBI Reference Sequence No. NP_000286.3, downloaded Sep. 27, 2023.

NCBI Reference Sequence No. WP_001297409.1, downloaded Aug. 14, 2023.

NCBI Reference Sequence No. WP_002989955.1, downloaded Jan. 9, 2024.

NCBI Reference Sequence No. WP_010922251.1, downloaded Jan. 9, 2024.

NCBI Reference Sequence No. WP_011054416.1, downloaded Jan. 9, 2024.

NCBI Reference Sequence No. WP_011284745.1, downloaded Jan. 9, 2024.

NCBI Reference Sequence No. WP_011285506.1, downloaded Jan. 9, 2024.

NCBI Reference Sequence No. WP_011527619.1, downloaded Jan. 9, 2024.

NCBI Reference Sequence No. WP_012560673.1, downloaded Jan. 9, 2024.

NCBI Reference Sequence No. WP_014407541.1, downloaded Jan. 9, 2024.

NCBI Reference Sequence No. WP_020905136.1, downloaded Jan. 9, 2024.

NCBI Reference Sequence No. WP_023080005.1, downloaded Jan. 9, 2024.

NCBI Reference Sequence No. WP_023610282.1, downloaded Jan. 9, 2024.

NCBI Reference Sequence No. WP_030125963.1, downloaded Jan. 9, 2024.

NCBI Reference Sequence No. WP_030126706.1, downloaded Jan. 9, 2024.

NCBI Reference Sequence No. WP_031488318.1, downloaded Jan. 9, 2024.

NCBI Reference Sequence No. WP_032188360.1, downloaded Apr. 9, 2024.

NCBI Reference Sequence No. WP_032460140.1, downloaded Jan. 9, 2024.

NCBI Reference Sequence No. WP_032461047.1, downloaded Jan. 9, 2024.

NCBI Reference Sequence No. WP_032462016.1, downloaded Jan. 9, 2024.

NCBI Reference Sequence No. WP_032462936.1, downloaded Jan. 9, 2024.

NCBI Reference Sequence No. WP_032464890.1, downloaded Jan. 9, 2024.

NCBI Reference Sequence No. WP_038431314.1, downloaded Jan. 9, 2024.

NCBI Reference Sequence No. WP_038432938.1, downloaded Jan. 9, 2024.

NCBI Reference Sequence No. WP_038434062.1, downloaded Jan. 9, 2024.

NCBI Reference Sequence No. WP_048327215.1, downloaded Jan. 9, 2024.

NCBI Reference Sequence No. WP_049519324.1, downloaded Jan. 9, 2024.

Nelson et al., "In vivo genome editing improves muscle function in a mouse model of Duchenne muscular dystrophy," Science, Jan. 22, 2016, vol. 351, No. 6271, pp. 403-407.

Newby et al. "Base editing of haematopoietic stem cells rescues sickle cell disease in mice", Nature, Nature Publishing Group UK, London, 2021, vol. 595, Article No. 7866, pp. 295-302, p. 296; Figure 1, p. 301.

Ngo et al., "Fetal haemoglobin levels and haematological characteristics of compound heterozygotes for haemoglobin S and deletional hereditary persistence of fetal haemoglobin," British Journal of Haematology, 2011, vol. 156, pp. 259-264.

O'Connell et al., Programmable RNA recognition and cleavage by CRISPR/Cas9. Nature, 2014, vol. 516, p. 263-266.

Ousterout et al., "Multiplex CRISPR/Cas9-based genome editing for correction of dystrophin mutations that cause Duchenne muscular dystrophy," Nature Communications, Feb. 2015, vol. 6, No. 6244, pp. 1-13.

Pattanayak et al., "High-throughput profiling of off-target DNA cleavage reveals RNA-programmed Cas9 nuclease specificity," Nature Biotechnology, Sep. 2013, vol. 31, No. 9, pp. 839-843.

Pournasr et al., "Modeling Inborn Errors of Hepatic Metabolism Using Induced Pluripotent Stem Cells," Arteriosclerosis, Thrombosis, and Vascular Biology, Nov. 2017, vol. 37, pp. 1994-1999.

U.S. Appl. No. 14/325,815, filed Jul. 6, 2021, Liu et al.

Addgene Plasmid No. 44246, Create Date Feb. 28, 2013.

Addgene Plasmid No. 73021, Create Date Apr. 20, 2016.

Addgene Plasmid No. 79620, Create Date Aug. 4, 2016.

Alexandrov et al., "Signatures of mutational processes in human cancer," Nature, Aug. 22, 2013, vol. 500, pp. 415-421.

Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.

Bae et al., "Cas-OFFinder: a fast and versatile algorithm that searches for potential off-target sites of Cas9 RNA-guided endonucleases," Bioinformatics, Jan. 24, 2014, vol. 30, No. 10, pp. 1473-1475.

Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079.

Branden and Tooze, "The Building Blocks," Introduction to Protein Structure, 1999, vol. 2, pp. 3-12.

Briner et al., "Guide RNA Functional Modules Direct Cas9 Activity and Orthogonality," Molecular Cell, Oct. 23, 2014, vol. 56, pp. 333-339.

Bulow et al., "Multienzyme systems obtained by gene fusion," Trends in Biotechnology, Jan. 1991, vol. 9, pp. 226-231.

Cameron, Ewan R., "Recent Advances in Transgenic Technology," Molecular Biotechnology, 1997, vol. 7, pp. 253-265.

Chatterjee et al., "A Cas9 with PAM recognition for adenine dinucleotides," Nature Communications, 2020, vol. 11, No. 2474, pp. 1-6.

Chester et al., "The apolipoprotein B mRNA editing complex performs a multifunctional cycle and suppresses nonsense-mediated decay," The EMBO Journal, 2003, vol. 22, No. 15, pp. 3971-3982.

Chichili et al., "Linkers in the structural biology of protein-protein interactions," Protein Science, 2013, vol. 22, pp. 153-167.

Chylinski et al., "The tracrRNA and Cas9 families of type II CRISPR-Cas immunity systems," RNA Biology, May 2013, vol. 10, No. 5, pp. 726-737.

Collantes et al., "Development and Characterization of a Modular CRISPR and RNA Aptamer Mediated Base Editing System," The CRISPR Journal, 2021, vol. 4, No. 1, pp. 58-68.

Cong et al., "Multiplex Genome Engineering Using CRISPR/Cas Systems," Science, Feb. 15, 2013, vol. 339, No. 6121, pp. 819-823.

Dai et al., "Bispecific CAR-T cells targeting both CD19 and CD22 for therapy of adults with relapsed or refractory B cell acute lymphoblastic leukemia," Journal of Hematology & Oncology, 2020, vol. 13, No. 30, pp. 1-11.

Deltcheva et al., "CRISPR RNA maturation by trans-encoded small RNA and host factor RNase III," Nature, Mar. 31, 2011, vol. 471, pp. 602-607.

(56)           References Cited

OTHER PUBLICATIONS

Depil et al., "Off-the-shelf allogeneic Car T cells: development and challenges," Nature Reviews Drug Discovery, 2020, pp. 1-15.
Endo et al., "Toward establishing an efficient and versatile gene targeting system in higher plants," Biocatalysis and Agricultural Biotechnology, 2014, vol. 3, pp. 2-6.
Ferretti et al., "Complete genome sequence of an M1 strain of *Streptococcus pyogenes,*" Proceedings of the National Academy of Sciences of the United States of America, Apr. 10, 2001, vol. 98, No. 8, pp. 4658-4663.
Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.
Freshney et al., "Culture of Animal Cells, A Manual of Basic Technique," Food and Chemical Toxicology, 1983, vol. 23, No. 3, pp. 403-404.
Fu et al., "Human cell based directed evolution of adenine base editors with improved efficiency," Nature Communications, 2021, vol. 12, No. 5897, pp. 1-11.
Gardlik et al., "Vectors and delivery systems in gene therapy," Medical Science Monitor, 2005, vol. 11, No. 4, pp. RA110-RA121.
Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.
Gasiunas et al., "RNA-dependent DNA endonuclease Cas9 of the CRISPR system: Holy Grail of genome editing?" Trends in Microbiology, Nov. 2013, vol. 21, No. 11, pp. 562-567.
Gaudelli et al., "Directed evolution of adenine base editors with increased activity and therapeutic application," Nature Biotechnology, 2020, pp. 1-15.
Gaudelli et al., "Programmable base editing of A•T to G•C in genomic DNA without DNA cleavage," Nature, Nov. 23, 2017, vol. 551, pp. 464-471.
Grunewald et al., "CRISPR DNA base editors with reduced RNA off-target and self-editing activities," Nature Biotechnology, Sep. 2019, vol. 37, No. 9, pp. 1041-1048.
Grunewald et al., "Transcriptome-wide off-target RNA editing induced by CRISPR-guided DNA base editors," Nature, May 2019, vol. 569, No. 7756, pp. 433-437.
Guilinger et al., "Fusion of catalytically inactive Cas9 to FokI nuclease improves the specificity of genome modification," Nature Biotechnology, 2014, pp. 1-6.
Guo et al., "Protein tolerance to random amino acid change," Proceedings of the National Academy of Sciences of the United States of America, Jun. 22, 2004, vol. 101, No. 25, pp. 9205-9210.
Hill et al., "Functional Analysis of Conserved Histidines in ADP-Glucose Pyrophosphorylase from *Escherichia coli,*" Biochemical Biophysical Research Communications, 1998, vol. 244, No. 2, pp. 573-577.
Houdebine, Louis-Marie, "The methods to generate transgenic animals and to control transgene expression," Journal of Biotechnology, 2002, vol. 98, pp. 145-160.
Hu et al., "Evolved Cas9 variants with broad PAM compatibility and high DNA specificity," Nature, Apr. 5, 2018, vol. 556, pp. 57-63.
Hua et al., "Expanding the base editing scope in rice by using Cas9 variants," Plant Biotechnology Journal, 2019, vol. 17, pp. 499-504.
Huang et al., "Circularly permuted and PAM-modified Cas9 variants broaden the targeting scope of base editors," Nature Biotechnology, Jun. 2019, vol. 37, No. 6, pp. 626-631.
Huang et al., "DNA epigenome editing using CRISPR-Cas SunTag-directed DNMT3A," Genome Biology, 2017, vol. 18, No. 176, pp. 1-11.
Jeong et al., "Adenine base editor engineering reduces editing of bystander cytosines," Nature Biotechnology, 2021, pp. 1-12.
Jeong et al., "Precise adenine base editors that exhibit minimized cytosine catalysis," Research Square, 2020, pp. 1-15.

Jiang et al., "Chemical modifications of adenine base editor mRNA and guide RNA expand its application scope," Nature Communications, 2020, vol. 11, No. 1979, pp. 1-9.
Jin et al., "Cytosine, but not adenine, base editors induce genome-wide off-target mutations in rice," Science, Apr. 19, 2019, vol. 364, pp. 292-295.
Jinek et al., "A Programmable Dual-RNA-Guided DNA Endonuclease in Adaptive Bacterial Immunity," Science, Aug. 17, 2012, vol. 337, No. 6096, pp. 816-821.
Jinek et al., "RNA-programmed genome editing in human cells," eLife, 2013, vol. 2, No. e00471, pp. 1-9.
Jore et al., "Structural basis for CRISPR RNA-guided DNA recognition by Cascade," Nature Structural & Molecular Biology, May 2011, vol. 18, No. 5, pp. 529-537.
June et al., "Chimeric Antigen Receptor Therapy," The New England Journal of Medicine, Jul. 5, 2018, vol. 379, No. 1, pp. 64-73.
Kappel et al., "Regulating gene expression in transgenic animals," Current Opinion in Biotechnology, 1992, vol. 3, pp. 548-553.
Kim et al., "Adenine base editors catalyze cytosine conversions in human cells," Nature Biotechnology, Oct. 2019, vol. 37, pp. 1145-1148.
Ren et al., "Multiplex Genome Editing to Generate Universal CAR T Cells Resistant to PD1 Inhibition," Clinical Cancer Research, May 1, 2017, vol. 23, No. 9, pp. 2255-2266.
Richter et al., "Phage-assisted evolution of an adenine base editor with improved Cas domain compatibility and activity," Nature Biotechnology, Jul. 2020, vol. 38, No. 7, pp. 883-891.
Sang, Helen, "Prospects for transgenesis in the chick," Mechanisms of Development, 2004, vol. 121, pp. 1179-1186.
Serreze et al., "Major Histocompatibility Complex Class I-Deficient NOD-B2mnull Mice are Diabetes and Insulitis Resistant," Diabetes, Mar. 1994, vol. 43, pp. 505-509.
Shimomura et al., "Complete genome sequencing and analysis of a Lancefield group G *Streptococcus dysgalactiae* subsp. *equisimilis* strain causing streptococcal toxic shock syndrome (STSS)," BMC Genomics, 2011, vol. 12, No. 17, pp. 1-17.
Shmakov et al., "Discovery and Functional Characterization of Diverse Class 2 CRISPR-Cas Systems," Molecular Cell, Nov. 5, 2015, vol. 60, pp. 385-397.
Slaymaker et al., "Rationally engineered Cas9 nucleases with improved specificity," Science, Jan. 1, 2016, vol. 351, No. 6268, pp. 84-88.
Stadtmauer et al., "First-in-Human Assessment of Feasibility and Safety of Multiplexed Genetic Engineering of Autologous T Cells Expressing NY-ESO-1 TCR and CRISPR/Cas9 Gene Edited to Eliminate Endogenous TCR and PD-1 (NYCE T cells) in Advanced Multiple Myeloma (MM) and Sarcoma," Blood, 2019, vol. 134, No. 49, Supplement 1, pp. 1-4.
Tan et al., "Engineering of high-precision base editors for site-specific single nucleotide replacement," Nature Communications, 2019, vol. 10, No. 439, pp. 1-10.
Tanenbaum et al., "A Protein-Tagging System for Signal Amplification in Gene Expression and Fluorescence Imaging," Cell, Oct. 23, 2014, vol. 159, pp. 635-646.
Teng et al., "Mutational analysis of apolipoprotein B mRNA editing enzyme (APOBEC1): structure-function relationships of RNA editing and dimerization," Journal of Lipid Research, 1999, vol. 40, pp. 623-635.
Themeli et al., "New Cell Sources for T Cell Engineering and Adoptive Immunotherapy," Cell Stem Cell, Apr. 2, 2015, vol. 16, pp. 357-366.
Tsai et al., "GUIDE-seq enables genome-wide profiling of off-target cleavage by CRISPR-Cas nucleases," Nature Biotechnology, Feb. 2015, vol. 33, No. 2, pp. 187-197.
UniProt Accession No. P01011, Create Date Jul. 21, 1986.
UniProt Accession No. Q99ZW2, Create Date Jul. 11, 2012.
UniProt Proteome ID No. UP000009215, Create Date May 2012.
Wacey et al., "Disentangling the perturbational effects of amino acid substitutions in the DNA-binding domain of p53," Human Genetics, 1999, vol. 104, pp. 15-22.
Walton et al., "Unconstrained genome targeting with near-PAMless engineered CRISPR-Cas9 variants," Science, Mar. 26, 2020, pp. 1-11.

(56)          References Cited

OTHER PUBLICATIONS

Wang et al., "Enhanced base editing by co-expression of free uracil DNA glycosylase inhibitor," Cell research, 2017, vol. 27, pp. 1289-1292.

Wang et al., "Eliminating base-editor-induced genome-wide and transcriptome-wide off-target mutations," Nature Cell Biology, 2021, pp. 1-32.

Webber et al., "Highly efficient multiplex human T cell engineering without double-strand breaks using Cas9 base editors," Nature Communications, 2019, vol. 10, No. 5222, pp. 1-10.

Wijesinghe et al., "Efficient deamination of 5-methylcytosines in DNA by human APOBEC3A, but not by AID or APOBEC3G," Nucleic Acids Research, Jul. 13, 2012, vol. 40, No. 18, pp. 9206-9217.

Wolf et al., "tadA, an essential tRNA-specific adenosine deaminase from *Escherichia coli*," The EMBO Journal, 2002, vol. 21, No. 14, pp. 3841-3851.

Xu et al., "Mechanisms of Relapse After CD19 Car T-Cell Therapy for Acute Lymphoblastic Leukemia and Its Prevention and Treatment Strategies," Frontiers in Immunology, Nov. 2019, vol. 10, No. 2664, pp. 1-15.

Yan et al., "Functionally diverse type V CRISPR-Cas systems," Science, Jan. 4, 2019, vol. 363, pp. 88-91.

Yang et al., "Engineering and optimising deaminase fusions for genome editing," Nature Communications, 2016, vol. 7, No. 13330, pp. 1-11.

Yang et al., "Increasing targeting scope of adenosine base editors in mouse and rat embryos through fusion of TadA deaminase with Cas9 variants," Protein & Cell, 2018, vol. 9, No. 9, pp. 814-819.

Yang et al., "PAM-Dependent Target DNA Recognition and Cleavage by C2c1 CRISPR-Cas Endonuclease," Cell, Dec. 15, 2016, vol. 167, pp. 1814-1828.

Yeh et al., "In vivo base editing of post-mitotic sensory cells," Nature Communications, 2018, vol. 9, No. 2184, pp. 1-10.

Yu et al., "Cytosine base editors with minimized unguided DNA and RNA off-target events and high on-target activity," Nature Communications, 2020, vol. 11, No. 2052, pp. 1-10.

Zafra et al., "Optimized base editors enable efficient editing in cells, organoids and mice," Nature Biotechnology, 2018, pp. 1-6.

Zheng et al., "DNA Editing in DNA/RNA Hybrids by Adenosine Deaminases That Act on RNA," Nucleic Acids Research, 2017, vol. 45, No. 6, pp. 3369-3377.

Zhou et al., "Atypical behaviour and connectivity in SHANK3-mutant macaques," Nature, Jun. 20, 2019, vol. 570, pp. 326-331.

Zhou et al., "Off-target RNA mutation induced by DNA base editing and its elimination by mutagenesis," Nature, Jul. 11, 2019, vol. 571, pp. 275-277.

Zuo et al., "Cytosine base editor generates substantial off-target singlenucleotide variants in mouse embryos," Science, vol. Apr. 19, 2019, vol. 364, No. 6437, pp. 289-292.

Zuris et al., "Efficient Delivery of Genome-Editing Proteins In Vitro and In Vivo," Nature Biotechnology, Jan. 2015, vol. 33, No. 1, pp. 73-80.

Burgess et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," The Journal of Cell Biology, Nov. 1990, vol. 111, pp. 2129-2138.

Cofsky et al., "CRISPR-Cas9 bends and twists DNA to read its sequence, " Nat Struct Mol Biol, Apr. 2022, vol. 29, No. 4, pp. 395-402.

Lin et al. "Structure-function relations in glucagon. Properties of highly purified Des-his1-, monoiodo-, and [Des-Asn28, Thr29](homoserine lactone27)-glucagon." Biochemistry vol. 14, No. 8, 1975, pp. 1559-1563.

Ma et al., "A new mutation in BFSP2 (G1091A) causes autosomal dominant congenital lamellar cataracts," Molecular Vision, Oct. 2008, vol. 14, pp. 1906-1911.

Schwartz et al., "A superactive insulin: [B10-Aspartic acid]insulin(human)," Proc. Natl. Acad. Sci. USA, Sep. 1987, vol. 84, pp. 6408-6411.

* cited by examiner

| Bulge Type | Bulge Size | Mismatch | TRAC exon 2 SD | TRAC exon 4 SA | B2M exon 1 SD | PD1 exon 1 SD | PD1 exon 2 STOP | RNF2 |
|---|---|---|---|---|---|---|---|---|
| X | 0 | 0 | 1 | 1 | 1 | 1 | 1 | 1 |
| X | 0 | 1 | 0 | 0 | 0 | 0 | 0 | 0 |
| X | 0 | 2 | 4 | 0 | 0 | 0 | 2 | 0 |
| X | 0 | 3 | 45 | 26 | 2 | 3 | 41 | 6 |
| X | 0 | 4 | 387 | 164 | 52 | 80 | 336 | 116 |
| RNA | 1 | 0 | 0 | 1 | 0 | 0 | 3 | 2 |
| RNA | 1 | 1 | 14 | 1 | 2 | 3 | 11 | 7 |
| RNA | 1 | 2 | 185 | 55 | 17 | 38 | 163 | 30 |
| Knockout: | | | | 95% | 95% | | 80% | |
| Indels: | | | | 0.6% | 2.5% | | 1.5% | |

FIG. 6

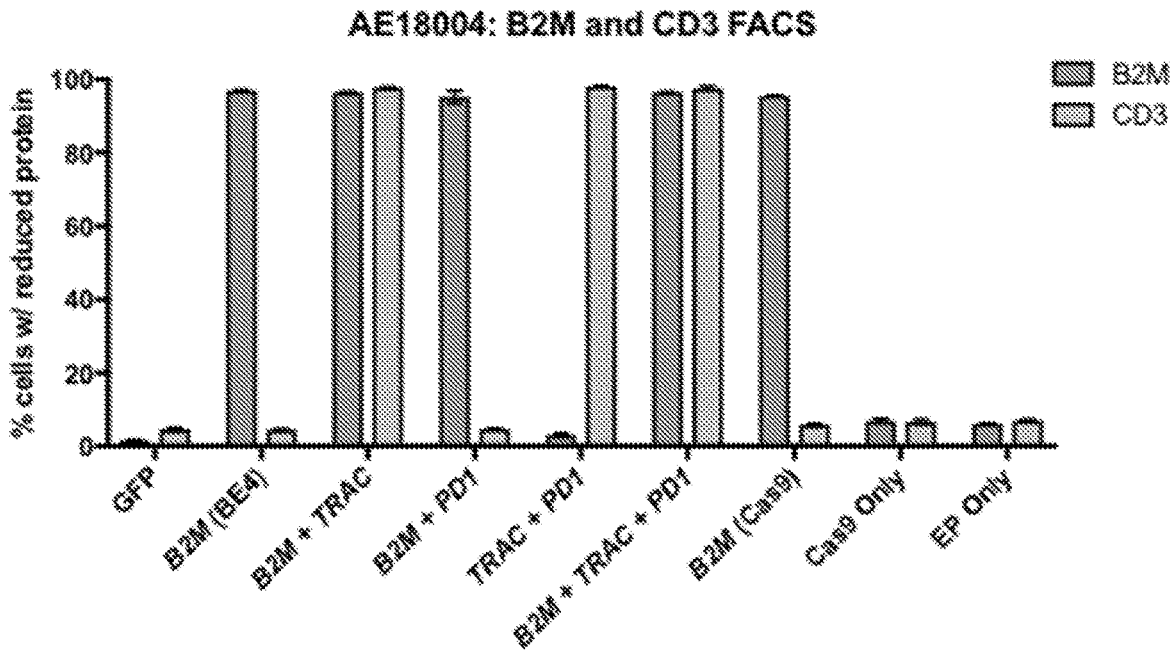
FIG. 7
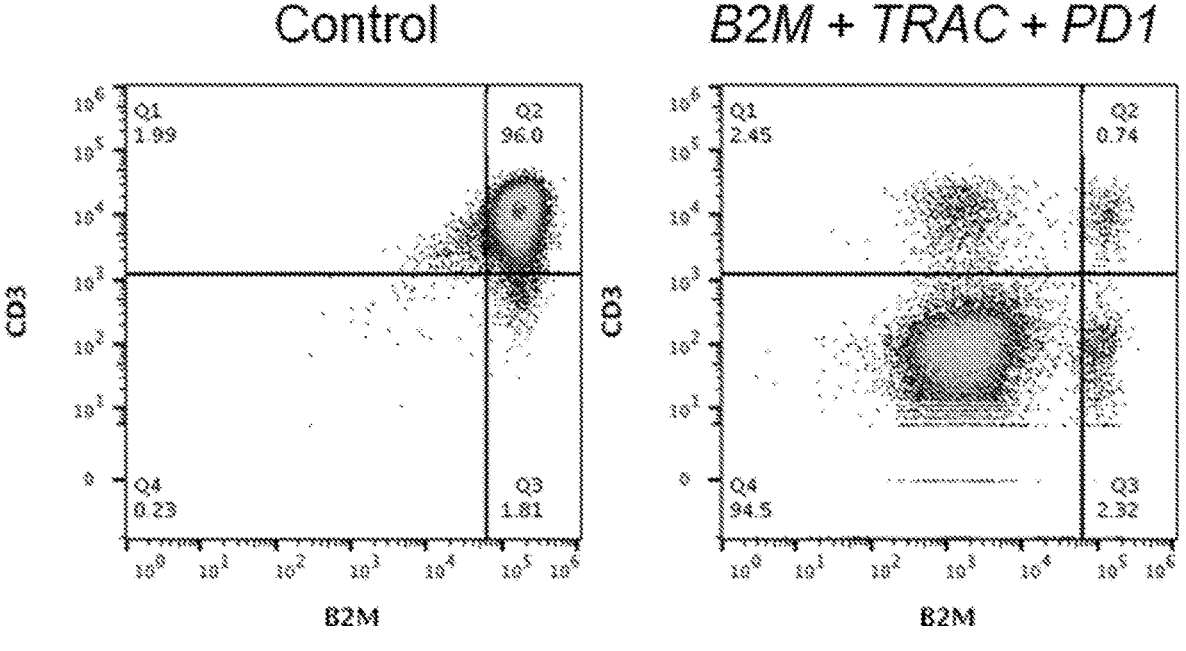
FIG. 8A                                                    FIG. 8B

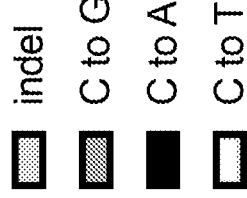
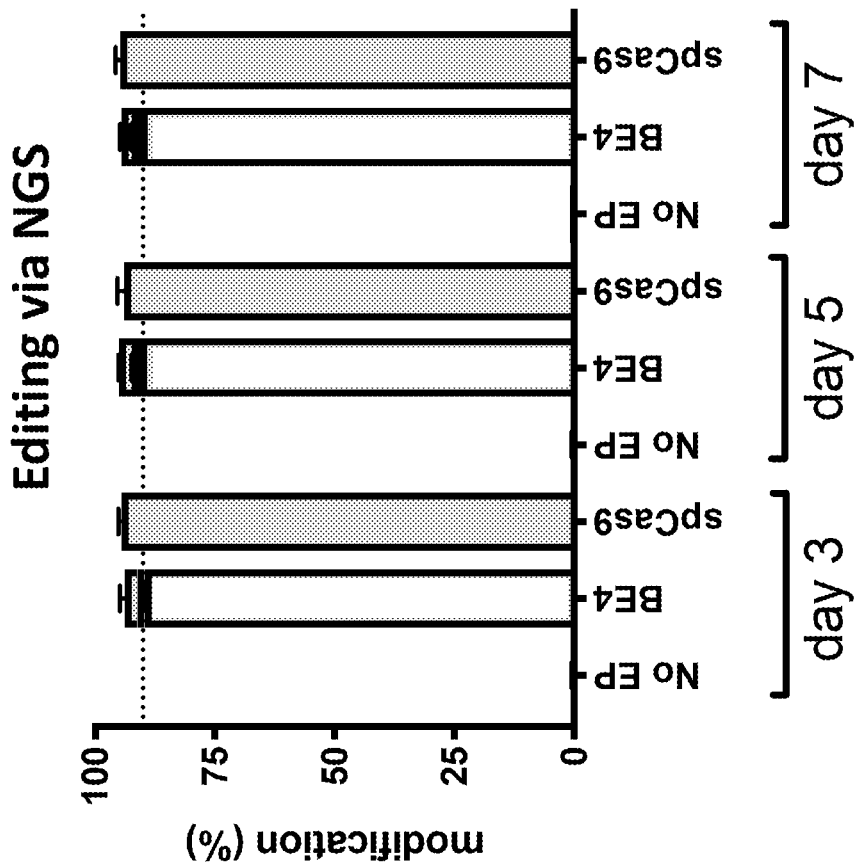
FIG. 18

Targets for CAR-T editing

FIG. 28B
Two strategies for silencing with base editors
1. Create a stop codon with CBE
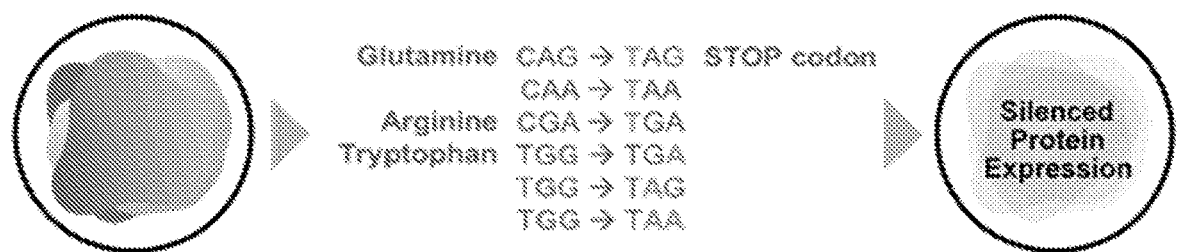
| | | | |
|---|---|---|---|
| Glutamine | CAG → TAG | STOP codon |
| | CAA → TAA | |
| Arginine | CGA → TGA | |
| Tryptophan | TGG → TGA | |
| | TGG → TAG | |
| | TGG → TAA | |
2. Splice disruption with CBE
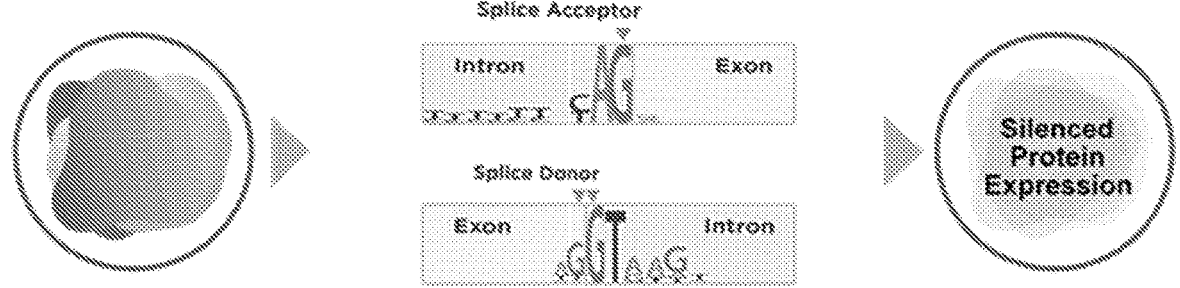

Multiple CAR-Ts required to address clonality of disease in AML

Multiple CAR-Ts Required to Eliminate Fratricide in T-ALL CAR-T Combination

Viability of cells post electroproation (AO/PI)

FIG. 38
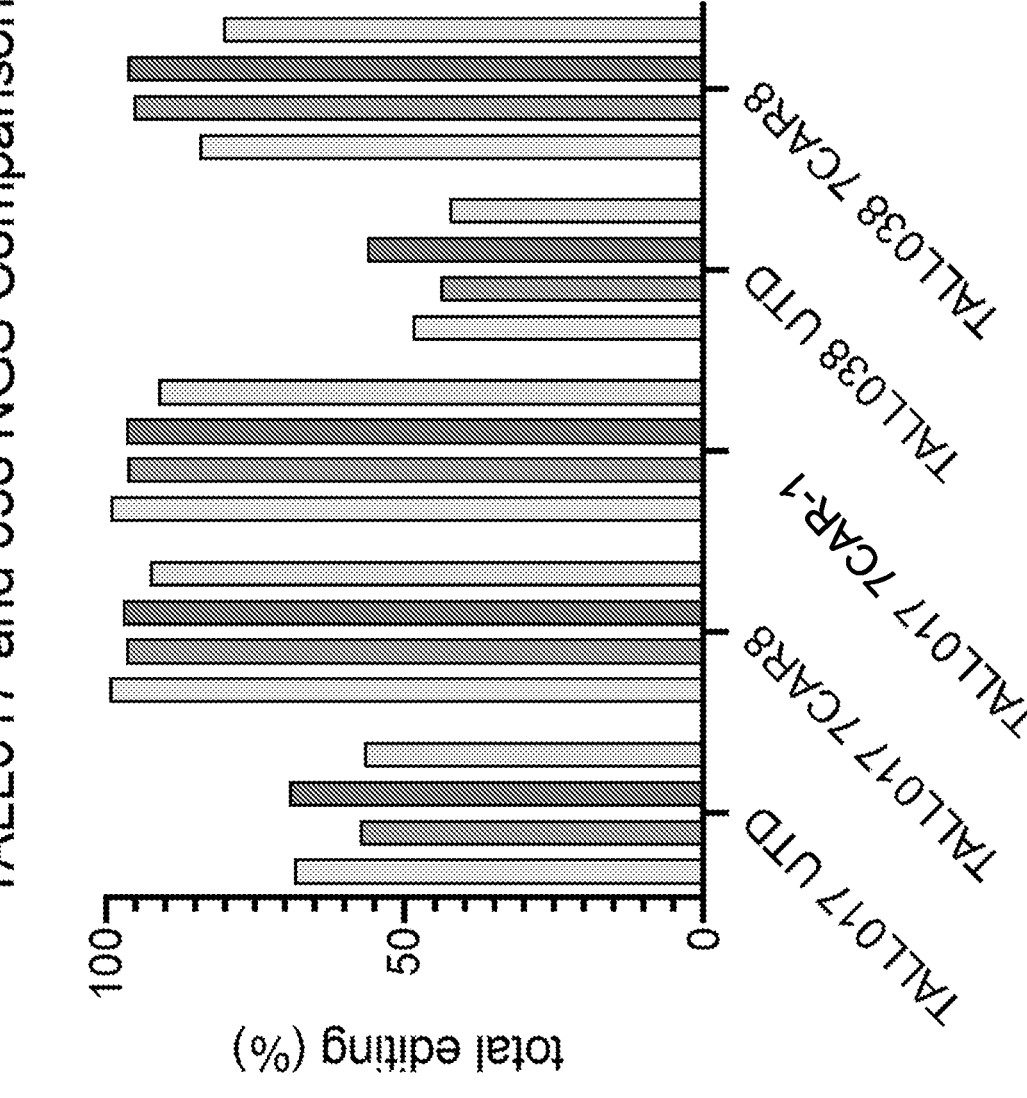
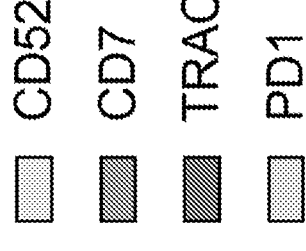

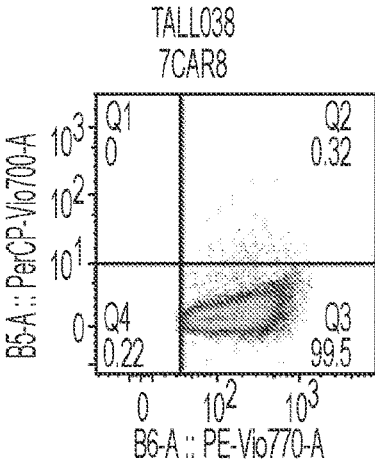
ADE 2020-05-26 TALL038 24hr post thaw Editing C5.0001.mqd
CD2+
30152
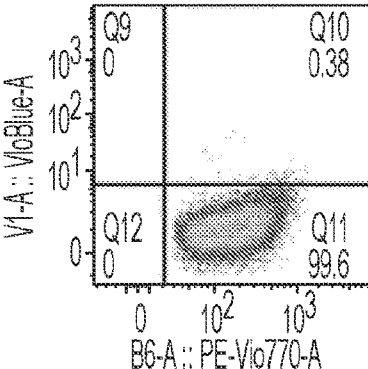
ADE 2020-05-26 TALL038 24hr post thaw Editing C5.0001.mqd
CD2+
30152
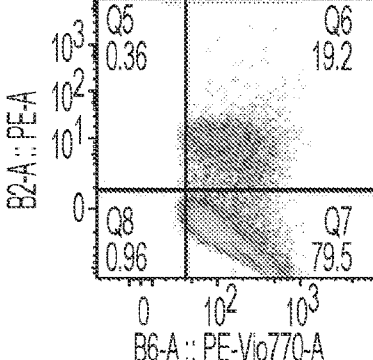
ADE 2020-05-26 TALL038 24hr post thaw Editing C5.0001.mqd
CD2+
30152
FIG. 39A
CONTINUED FIG. 44
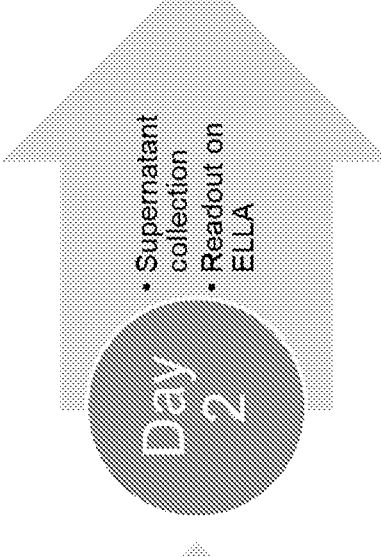
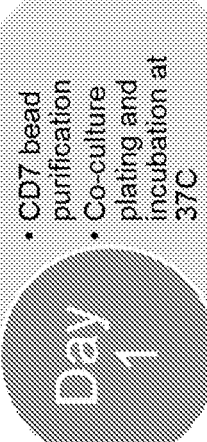

3 Donors 72h Post EP

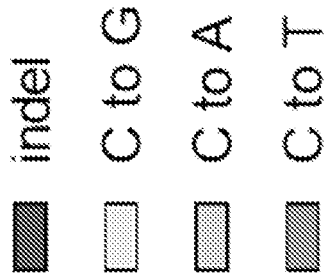
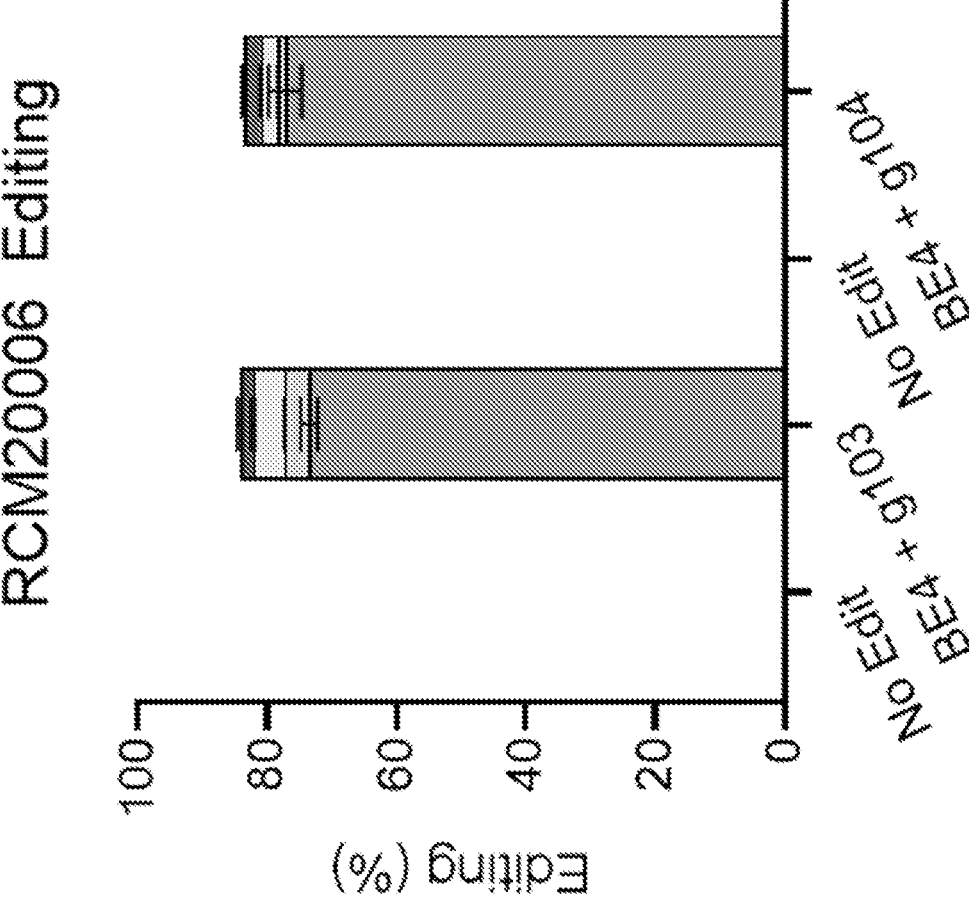
FIG. 54

Top CAR LVV by Hinge Sequence

FIG. 59A
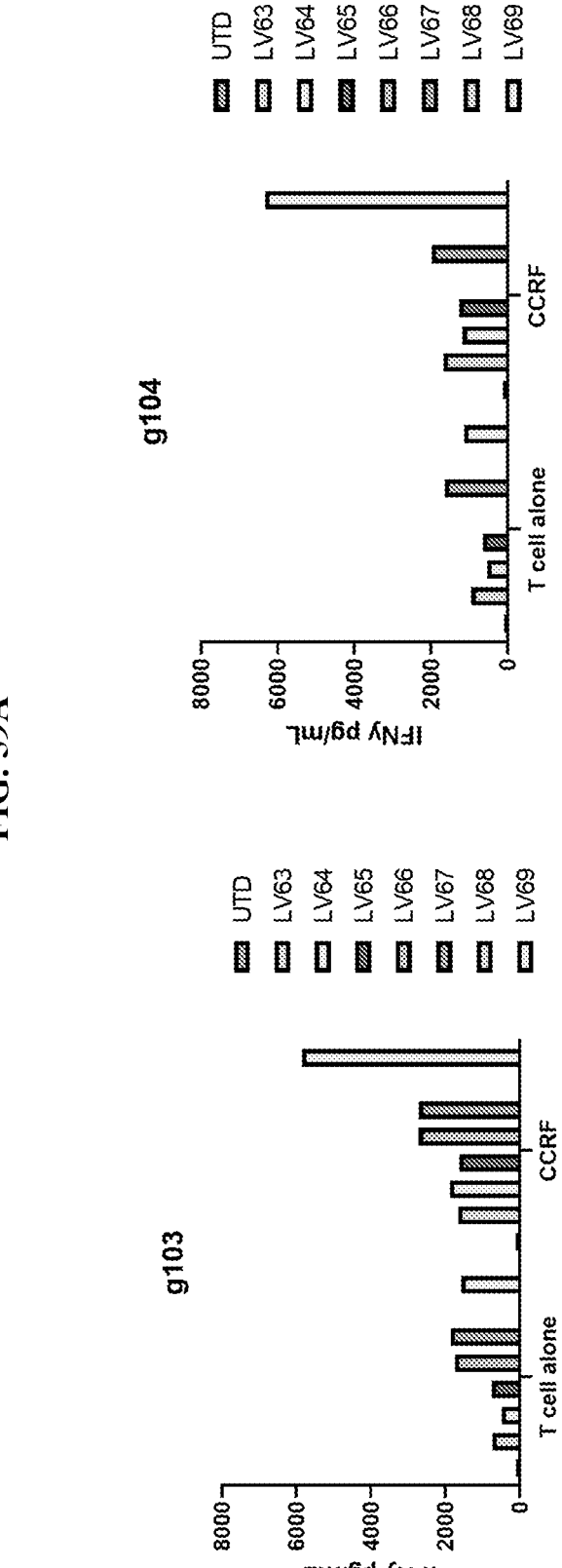
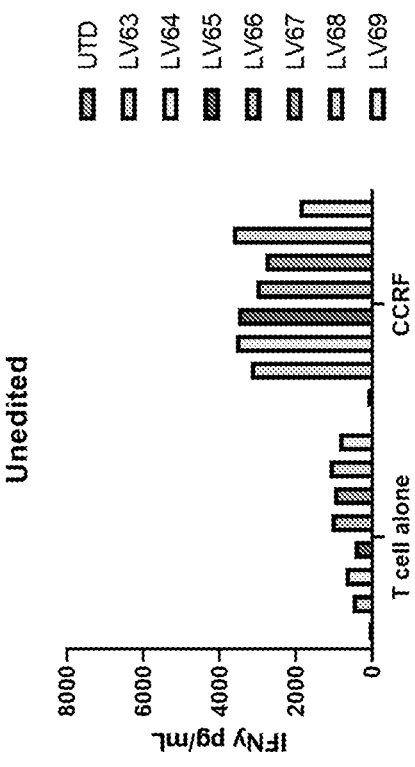

COMPOSITIONS AND METHODS FOR TREATMENT OF LIQUID CANCERS

CROSS REFERENCE TO RELATED APPLICATIONS

This application is the U.S. National Stage Application, pursuant to 35 U.S.C. § 371 of International PCT Application No. PCT/US2020/052822, filed Sep. 25, 2020 designating the United States and published in English, which claims priority to and the benefit of U.S. Provisional Application No. 62/907,254, filed Sep. 27, 2019, the entire contents of which are hereby incorporated by reference in its entirety.

SEQUENCE LISTING STATEMENT

The instant application contains a Sequence Listing which has been submitted electronically in ASCII format and is hereby incorporated by reference in its entirety. Said ASCII copy, created on Jul. 31, 2020, is named 180802_043301_PCT_SL.txt and is 2,270,064 bytes in size.

BACKGROUND OF THE INVENTION

Autologous and allogeneic immunotherapies are neoplasia treatment approaches in which immune cells expressing chimeric antigen receptors are administered to a subject. To generate an immune cell that expresses a chimeric antigen receptor (CAR), the immune cell is first collected from the subject (autologous) or a donor separate from the subject receiving treatment (allogeneic) and genetically modified to express the chimeric antigen receptor. The resulting cell expresses the chimeric antigen receptor on its cell surface (e.g., CAR T-cell), and upon administration to the subject, the chimeric antigen receptor binds to the marker expressed by the neoplastic cell. This interaction with the neoplasia marker activates the CAR-T cell, which then cell kills the neoplastic cell. But for autologous or allogeneic cell therapy to be effective and efficient, significant conditions and cellular responses, such as T cell signaling inhibition, must be overcome or avoided. For allogeneic cell therapy, graft versus host disease and host rejection of CAR-T cells may provide additional challenges. Editing genes involved in these processes can enhance CAR-T cell function and resistance to immunosuppression or inhibition, but current methodologies for making such edits have the potential to induce large, genomic rearrangements in the CAR-T cell, thereby negatively impacting its efficacy. Thus, there is a significant need for techniques to more precisely modify immune cells, especially CAR-T cells. This application is directed to this and other important needs.

SUMMARY OF THE INVENTION

As described below, the present invention features genetically modified immune cells having enhanced anti-neoplasia activity, resistance to immune suppression, and decreased risk of eliciting a graft versus host reaction, or host versus graft reaction where host CD8+ T cells recognize a graft as non-self (e.g., where a transplant recipient generates an immune response against the transplanted organ), or a combination thereof. In one embodiment, a subject having or having a propensity to develop graft versus host disease (GVHD) is administered a CAR-T cell that lacks or has reduced levels of functional TRAC. In one embodiment, a subject having or having a propensity to develop host versus graft disease (HVGD) is administered a CAR-T cell that lacks or has reduced levels of functional beta2 microglobulin (B2M). The present invention also features methods for producing and using these modified immune cells.

In one aspect, the invention provides a composition comprising two or more immune cells, each immune cell comprising a) a different chimeric antigen receptor that targets an antigen selected from the group consisting of CD5, CD7, CD3, CD33, and CD123, wherein the immune cells comprise mutations that reduce or eliminate expression of the targeted antigens; and b) one or more mutations that reduce or eliminate the expression of an immunogenic polypeptide selected from the group consisting of TRAC, LAG-3, FAS, CIITA, TRBC1, TRBC2, CD52, B2M, and PD1. In some embodiments, one of the immune cells comprises a chimeric antigen receptor that targets CD5 and another immune cell comprises a chimeric antigen receptor that targets an antigen selected from the group consisting of CD7, CD3, CD33, and CD123. In some embodiments, the composition comprises at least three immune cells each comprising a chimeric antigen receptor that targets a different antigen, wherein the targeted antigens are CD3, CD5, and CD7. In some embodiments, one of the immune cells expresses a chimeric antigen receptor that targets CD7 and another immune cell expresses a chimeric antigen receptor that targets an antigen selected from the group consisting of CD3, CD33, and CD123. In some embodiments, one of the immune cells expresses a chimeric antigen receptor that targets CD3 and another immune cell expresses a chimeric antigen receptor that targets an antigen selected from the group consisting of CD33, and CD123. In some embodiments, one of the immune cells expresses a chimeric antigen receptor that targets CD33 and another immune cell expresses a chimeric antigen receptor that targets CD123. In some embodiments, one immune cell expresses two, three, four or more different chimeric antigen receptors. In some embodiments, one of the chimeric antigen receptors targets CD5 and another chimeric antigen receptor targets an antigen selected from the group consisting of CD7, CD3, CD33, and CD123. In some embodiments, one of the chimeric antigen receptors targets CD7 and another chimeric antigen receptor targets an antigen selected from the group consisting of CD3, CD33, and CD123. In some embodiments, one of the chimeric antigen receptors targets CD3 and another chimeric antigen receptor targets an antigen selected from the group consisting of CD33, and CD123. In some embodiments, one of the chimeric antigen receptors targets CD33 another chimeric antigen receptor targets CD123.

In another aspect, the invention provides a composition comprising at least three immune cells, each comprising a different chimeric antigen receptor, wherein one chimeric antigen receptor targets CD3, one targets CD5, and a third targets CD7, wherein the cells further comprise mutations that reduce or eliminate the expression of the targeted antigens; and further comprise one or more mutations that reduce or eliminate the expression of a polypeptide selected from the group consisting of TRAC, LAG-3, FAS, CIITA, TRBC1, TRBC2, CD52, B2M, and PD1.

In yet another aspect, the invention provides a composition comprising at least two immune cells, each comprising a different chimeric antigen receptor, wherein one chimeric antigen receptor targets CD3 and another targets CD7, wherein the cells further comprise mutations that reduce or eliminate the expression of the targeted antigens; and further comprise one or more mutations that reduce or eliminate the expression of a polypeptide selected from the group consisting of TRAC, LAG-3, FAS, CIITA, TRBC1, TRBC2, CD52, B2M, and PD1.

In one aspect, the invention provides a composition comprising at least two immune cells, each comprising a different chimeric antigen receptor, wherein one chimeric antigen receptor targets CD5 and another targets CD7, wherein the cells further comprise mutations that reduce or eliminate the expression of the targeted antigens; and further comprise one or more mutations that reduce or eliminate the expression of a polypeptide selected from the group consisting of TRAC, LAG-3, FAS, CIITA, TRBC1, TRBC2, CD52, B2M, and PD1.

In another aspect, the invention provides a composition comprising at least two immune cells, each comprising a different chimeric antigen receptor, wherein one chimeric antigen receptor targets CD3 and another targets CD5, wherein the cells further comprise mutations that reduce or eliminate the expression of the targeted antigens; and further comprise one or more mutations that reduce or eliminate the expression of a polypeptide selected from the group consisting of TRAC, LAG-3, FAS, CIITA, TRBC1, TRBC2, CD52, B2M, and PD1.

In yet another aspect, the invention provides a composition comprising at least two immune cells, each comprising a different chimeric antigen receptor, wherein one chimeric antigen receptor targets CD33 and another targets CD123, wherein the cells further comprise mutations that reduce or eliminate the expression of the targeted antigen; and further comprise one or more mutations that reduce or eliminate the expression of a polypeptide selected from the group consisting of TRAC, LAG-3, FAS, CIITA, TRBC1, TRBC2, CD52, B2M, and PD1.

In some embodiments, the mutation is a C to T or A to G mutation that silences the gene or that introduces a stop codon into the gene. In some embodiments, the mutation introduces a premature stop codon or alters a splice donor or acceptor site. In some embodiments, the mutation is generated by a base editor comprising a deaminase domain. In some embodiments, the deaminase is a cytidine or an adenosine deaminase. In some embodiments, the base editor is BE4. In some embodiments, the mutation reduces expression of an encoded polypeptide by about 50% or more relative to a corresponding control cell lacking the mutation. In some embodiments, the composition comprises a population of immune cells. In some embodiments, at least 50% of the population comprises one or more mutations that reduce or eliminate expression of the targeted antigen and/or the immunogenic polypeptide. In some embodiments, the immune cells are fratricide resistant. In some embodiments, the immune cells have increased anti-neoplasia activity. In some embodiments, the immune cells comprise no detectable translocations. In some embodiments, the immune cells comprise less than 1% indels. In some embodiments, the immune cell is a mammalian cell. In some embodiments, the mammalian cell is a human or rodent cell. In some embodiments, the immune cell is a cytotoxic T cell, a regulatory T cell, a T helper cell, a dendritic cell, a B cell, or a NK cell, or a progenitor thereof. In some embodiments, the progenitor is a hematopoietic stem cell.

In one aspect, the invention provides a pharmaceutical composition comprising an effective amount of any of the compositions provided herein and a pharmaceutically acceptable excipient.

In another aspect, the invention provides a base editor system comprising a fusion protein comprising a nucleic acid programmable DNA binding protein (napDNAbp) and a deaminase domain, and at least two guide polynucleotides each targeting a different antigen, wherein the antigens are selected from the group consisting of CD5, CD7, CD3, CD33, and CD123. In some embodiments, one guide polynucleotide targets CD5 and another targets an antigen selected from the group consisting of CD7, CD3, CD33, and CD123. In some embodiments, the system comprising three guide polynucleotides each of which targets one of antigens CD3, CD5, and CD7. In some embodiments, one guide polynucleotide targets CD7 and another targets an antigen selected from the group consisting of CD3, CD33, and CD123. In some embodiments, one guide polynucleotide targets CD3 and another targets an antigen selected from the group consisting of CD33, and CD123. In some embodiments, one guide polynucleotide targets CD33 and another targets CD123.

In some embodiments, the guide polynucleotides each comprise a nucleic acid sequence selected from Table 26. In some embodiments, the guide polynucleotide comprises a nucleic acid sequence selected from AGCGACUGCAGAAAGAAGAG (SEQ ID NO: 1) or CAUACCAGCUGAGCCGUCCG (SEQ ID NO: 2). In some embodiments, the fusion protein further comprises one or more uracil glycosylase inhibitors (UGIs) and/or one or more nuclear localization sequences (NLS). In some embodiments, the napDNAbp comprises a Cas9, Cas12a/Cpf1, Cas12b/C2cl, Cas12c/C2c3, Cas12d/CasY, Cas12e/CasX, Cas12g, Cas12h, Cas12i, or Cas12j/CasΦ polypeptide or a portion thereof. In some embodiments, the napDNAbp comprises a Cas12 polypeptide or a fragment thereof. In some embodiments, the napDNAbp comprises a Cas9 polypeptide or a fragment thereof. In some embodiments, the Cas9 is a dead Cas9 (dCas9) or a Cas9 nickase (nCas9). In some embodiments, the Cas9 is a modified *Staphylococcus aureus* Cas9 (SaCas9), *Streptococcus thermophilus* 1 Cas9 (St1Cas9), or a modified *Streptococcus pyogenes* Cas9 (SpCas9). In some embodiments, the Cas9 comprises an altered protospacer-adjacent motif (PAM) specificity. In some embodiments, the altered PAM has specificity for the nucleic acid sequence 5'-NGC-3'.

In some embodiments, the deaminase domain is capable of deaminating cytidine or adenosine. In some embodiments, the deaminase domain is a cytidine or an adenosine deaminase domain. In some embodiments, the cytidine deaminase is an APOBEC deaminase. In some embodiments, the adenosine deaminase is a TadA variant. In some embodiments, the TadA variant is a TadA*8 variant. In some embodiments, the TadA*8 variant is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24. In some embodiments, the TadA variant is a TadA*9 variant.

In one aspect, the invention provides a pharmaceutical composition comprising any of the base editor systems as provided herein.

In another aspect, the invention provides a polynucleotide encoding any of the base editor systems and guide polynucleotides as provided herein.

In yet another aspect, the invention provides a vector comprising any of the polynucleotides as provided herein. In some embodiments, the vector is a viral vector. In some embodiments, the viral vector is a retroviral vector, adenoviral vector, lentiviral vector, herpesvirus vector, or adeno-associated viral vector (AAV).

In one aspect, the invention provides a pharmaceutical composition comprising any of the polynucleotides or any of the vectors as provided herein.

In one aspect, the invention provides a method for producing a CAR-expressing immune cell having reduced immunogenicity. In some embodiments, the method includes expressing in a CAR-expressing immune cell a base editor system comprising a fusion protein comprising a nucleic acid programmable DNA binding protein (napD-NAbp) and a deaminase domain, and two guide polynucleotides each targeting a polynucleotide encoding a different antigen, wherein the antigens are selected from the group consisting of CD5, CD7, CD3, CD33, and CD123, thereby producing a CAR-expressing immune cell having reduced immunogenicity. In some embodiments, the immune cell expresses or is contacted with a guide polynucleotide that targets a polynucleotide encoding a polypeptide selected from the group consisting of TRAC, LAG-3, FAS, CIITA, TRBC1, TRBC2, CD52, B2M, and PD1.

In some embodiments, the method includes (a) expressing in a CAR-expressing immune cell a base editor system comprising a fusion protein comprising a nucleic acid programmable DNA binding protein (napDNAbp) and a deaminase domain; and (b) contacting the CAR-expressing immune cell with at least two guide polynucleotides each targeting a polynucleotide encoding a different antigen, wherein the antigens are selected from the group consisting of CD5, CD7, CD3, CD33, and CD123, thereby producing a CAR-expressing immune cell having reduced immunogenicity.

In some embodiments, the method further includes contacting the CAR-expressing immune cell with a guide polynucleotide that targets a polynucleotide encoding a polypeptide selected from the group consisting of TRAC, LAG-3, FAS, CIITA, TRBC1, TRBC2, CD52, B2M, and PD1. In some embodiments, the immune cell expresses a chimeric antigen receptor (CAR) that targets an antigen selected from the group consisting of CD5, CD7, CD3, CD33, and CD123. In some embodiments, the method further includes introducing a mutation that reduces or eliminates the expression of at least one polypeptide selected from the group consisting of TRAC, LAG-3, FAS, CIITA, TRBC1, TRBC2, CD52, B2M, and PD1 into the immune cells, thereby producing a population of CAR-expressing immune cells having reduced immunogenicity.

In one aspect, the invention provides a method for producing a population of CAR-expressing immune cells having reduced immunogenicity. In some embodiments, the method includes a) introducing a mutation that reduces or eliminates the expression of at an antigen selected from the group consisting of CD5, CD7, CD3, CD33, and CD123 into one immune cell and a different mutation in one of said antigens into a second immune cell; and b) introducing a mutation that reduces or eliminates the expression of at least one polypeptide selected from the group consisting of TRAC, LAG-3, FAS, CIITA, TRBC1, TRBC2, CD52, B2M, and PD1 into the immune cells, thereby producing a population of CAR-expressing immune cells having reduced immunogenicity. In some embodiments, the chimeric antigen receptor expressed by the immune cell targets an antigen selected from the group consisting of CD3, CD5, CD7, CD33, and CD123. In some embodiments, an immune cell produced by the method expresses a chimeric antigen receptor that targets a CD3, CD5, and/or CD7 antigen and fails to express or expresses a reduced level of a CD3, CD5, and/or CD7 antigen. In some embodiments, an immune cell produced by the method expresses a chimeric antigen receptor that targets a CD33 and a CD123 antigen and fails to express or expresses a reduced level of a CD33 and a CD123 antigen. In some embodiments, the CAR is a CD5 chimeric antigen receptor (CAR). In some embodiments, the CD5 CAR is encoded by a CD5 CAR construct presented in Table 28.

In another aspect, the invention provides a method for producing an immune cell having reduced immunogenicity. In some embodiments, the method includes a) introducing a mutation in an endogenous CD5 gene sequence or regulatory element that reduces or eliminates expression of CD5; and b) expressing in the cell a CD5 CAR construct presented in Table 28. In some embodiments, the CD5 CAR construct encodes a CD5 CAR polypeptide that comprises or consists of an amino acid sequence selected from the following:

```
a)
    1  MEFGLSWLFLVAILKGVQCIDAMGNIQLVQSGPELKKPGETVKISCKASGYTFTNYGMNW   60

61  VKQAPGKGLRWMGWINTHTGEPTYADDFKGRFAFSLETSASTAYLQINNLKNEDTATYFC  120

121  TRRGYDWYFDVWGAGTTVTVSSGGGGSGGGGSGGGGSDIKMTQSPSSMYASLGERVTITC  180

181  KASQDINSYLSWFHHKPGKSPKTLIYRANRLVDGVPSRFSGSGSGQDYSLTISSLDYEDM  240

241  GIYYCQQYDESPWTFGGGTKLEMKGSGDPAEPKSPDKTHTCPGQPREPQVYTLPPSRDEL  300

301  TKNQVSLTCLVKGFYPSDIAVEWESNGQPENNYKTTPPVLDSDGSFFLYSKLTVDKSRWQ  360

361  QGNVFSCSVMHEALHNHYTQKSLSLSPGKKDPKFWVLVVVGGVLACYSLLVTVAFIIFWV  420

421  RSKRSRLLHSDYMNMTPRRPGPTRKHYQPYAPPRDFAAYRSRVKFSRSADAPAYQQGQNQ  480

481  LYNELNLGRREEYDVLDKRRGRDPEMGGKPRRKNPQEGLYNELQKDKMAEAYSE1GMKGE  540

541  RRRGKGHDGLYQGLSTATKDTYDALHMQALPPR;                           573 b)
    1  MEFGLSWLFLVAILKGVQCIDAMGNIQLVQSGPELKKPGETVKISCKASGYTFTNYGMNW   60

61  VKQAPGKGLRWMGWINTHTGEPTYADDFKGRFAFSLETSASTAYLQINNLKNEDTATYFC  120

121  TRRGYDWYFDVWGAGTTVTVSSGGGGSGGGGSGGGGSDIKMTQSPSSMYASLGERVTITC  180

181  KASQDINSYLSWFHHKPGKSPKTLIYRANRLVDGVPSRFSGSGSGQDYSLTISSLDYEDM  240
```

-continued

```
241 GIYYCQQYDESPWTFGGGTKLEMKGSGDPATTTPAPRPPTPAPTIASQPLSLRPEACRPA 300

301 AGGAVHTRGLDFACDFWVLVVVGGVLACYSLLVTVAFIIFWVRSKRSRLLHSDYMNMTPR 360

361 RPGPTRKHYQPYAPPRDFAAYRSRVKFSRSADAPAYQQGQNQLYNELNLGRREEYDVLDK 420

421 RRGRDPEMGGKPRRKNPQEGLYNELQKDKMAEAYSEIGMKGERRRGKGHDGLYQGLSTAT 480

481 KDTYDALHMQALPPR;                                              495
``` c)
```
  1 MEFGLSWLFLVAILKGVQCIDAMGNIQLVQSGPELKKPGETVKISCKASGYTFTNYGMNW   60

61 VKQAPGKGLRWMGWINTHTGEPTYADDFKGRFAFSLETSASTAYLQINNLKNEDTATYFC 120

121 TRRGYDWYFDVWGAGTTVTVSSGGGGSGGGGSGGGGSDIKMTQSPSSMYASLGERVTITC 180

181 KASQDINSYLSWFHHKPGKSPKTLIYRANRLVDGVPSRFSGSGSGQDYSLTISSLDYEDM 240

241 GIYYCQQYDESPWTFGGGTKLEMKGSGDPAIEVMYPPPYLDNEKSNGTIIHVKGKHLCPS 300

301 PLFPGPSKPFWVLVVVGGVLACYSLLVTVAFIIFWVRSKRSRLLHSDYMNMTPRRPGPTR 360

361 KHYQPYAPPRDFAAYRSRVKFSRSADAPAYQQGQNQLYNELNLGRREEYDVLDKRRGRDP 420

421 EMGGKPRRKNPQEGLYNELQKDKMAEAYSEIGMKGERRRGKGHDGLYQGLSTATKDTYDA 480

481 LHMQALPPR;                                                    489
``` d)
```
  1 MEFGLSWLFLVAILKGVQCIDAMGNIQLVQSGPELKKPGETVKISCKASGYTFTNYGMNW   60

61 VKQAPGKGLRWMGWINTHTGEPTYADDFKGRFAFSLETSASTAYLQINNLKNEDTATYFC 120

121 TRRGYDWYFDVWGAGTTVTVSSGGGGSGGGGSGGGGSDIKMTQSPSSMYASLGERVTITC 180

181 KASQDINSYLSWFHHKPGKSPKTLIYRANRLVDGVPSRFSGSGSGQDYSLTISSLDYEDM 240

241 GIYYCQQYDESPWTFGGGTKLEMKGSGDPAEPKSPDKTHTCPGQPREPQVYTLPPSRDEL 300

301 TKNQVSLTCLVKGFYPSDIAVEWESNGQPENNYKTTPPVLDSDGSFFLYSKLTVDKSRWQ 360

361 QGNVFSCSVMHEALHNHYTQKSLSLSPGKKDPKPTTTPAPRPPTPAPTIASQPLSLRPEA 420

421 CRPAAGGAVHTRGLDFACDIYIWAPLAGTCGVLLLSLVITLYCKRGRKKLLYIFKQPFMR 480

481 PVQTTQEEDGCSCRFPEEEEGGCELRVKFSRSADAPAYQQGQNQLYNELNLGRREEYDVL 540

541 DKRRGRDPEMGGKPRRKNPQEGLYNELQKDKMAEAYSEIGMKGERRRGKGHDGLYQGLST 600

601 ATKDTYDALHMQALPPR;                                            617
``` or e)
```
  1 MEFGLSWLFLVAILKGVQCIDAMGNIQLVQSGPELKKPGETVKISCKASGYTFTNYGMNW   60

61 VKQAPGKGLRWMGWINTHTGEPTYADDFKGRFAFSLETSASTAYLQINNLKNEDTATYFC 120

121 TRRGYDWYFDVWGAGTTVTVSSGGGGSGGGGSGGGGSDIKMTQSPSSMYASLGERVTITC 180

181 KASQDINSYLSWFHHKPGKSPKTLIYRANRLVDGVPSRFSGSGSGQDYSLTISSLDYEDM 240

241 GIYYCQQYDESPWTFGGGTKLEMKGSGDPATTTPAPRPPTPAPTIASQPLSLRPEACRPA 300

301 AGGAVHTRGLDFACDIYIWAPLAGTCGVLLLSLVITLYCKRGRKKLLYIFKQPFMRPVQT 360

361 TQEEDGCSCRFPEEEEGGCELRVKFSRSADAPAYQQGQNQLYNELNLGRREEYDVLDKRR 420

421 DPEMGGKPRRKNPQEGLYNELQKDKMAEAYSEIGMKGERRRGKGHDGLYQGLSTATKD   480

481 DALHMQALPPRX.                                                 494
```

In some embodiments, the immune cell produced by the method exhibits fratricide resistance and/or increased anti-neoplasia activity as compared to a corresponding control cell. In some embodiments, the method is carried out in vivo or ex vivo. In some embodiments, the immune cell produced by the method comprises no detectable translocations. In some embodiments, the immune cell produced by the method comprises less than 1% indels. In some embodiments, the immune cell produced by the method comprises less than 5% of non-target edits. In some embodiments, the immune cell produced by the method comprises less than 5% of off-target edits. In some embodiments, the mutation is generated by nucleobase modification. In some embodiments, the mutation is in an exon. In some embodiments, the mutation results in a premature stop codon that reduces or eliminates protein expression. In some embodiments, the mutation is in a splice donor site or a splice acceptor site. In some embodiments, one or more mutations is generated by contacting a target polynucleotide with a base editor system comprising a fusion protein comprising a nucleic acid programmable DNA binding protein (napDNAbp), a deaminase, and one or more guide polynucleotides.

In some embodiments, the deaminase is an adenosine or cytidine deaminase. In some embodiments, the cytidine deaminase is BE4. In some embodiments, the mutation reduces expression of an encoded polypeptide by at least about 50% or more relative to a corresponding control cell lacking the mutation. In some embodiments, the guide polynucleotide comprises a sequence selected from those provided at Table 26. In some embodiments, the guide polynucleotide comprises a nucleic acid sequence selected from AGCGACUGCAGAAAGAAGAG (SEQ ID NO: 1) or CAUACCAGCUGAGCCGUCCG (SEQ ID NO: 2). In some embodiments, each of the one or more guide nucleic acid sequences targets the napDNAbp to a CD5, FAS, LAG-3, CD52, TRAC, B2M, CIITA, TRBC1, TRBC2 and/or a PDC1/PD-1 gene, or regulatory element. In some embodiments, the base editor and one or more guide nucleic acid sequences are introduced into the immune cell via electroporation, nucleofection, cationic lipid-mediated methods, viral transduction, or a combination thereof. In some embodiments, the method further includes expanding the immune cell in culture to generate a population of immune cells. In some embodiments, expression of the antigen or polypeptide is reduced in at least about 50% of the population of immune cells. In some embodiments, the method further includes depleting TCRα/β+ cells from the population of modified immune cells.

In one aspect, the invention provides a CAR-expressing immune cell having reduced immunogenicity produced by any of the methods as provided herein.

In another aspect, the invention provides a pharmaceutical composition comprising any of the immune cells as provided herein. In some embodiments, the pharmaceutical composition includes a pharmaceutically acceptable excipient.

In yet another aspect, the invention provides a method for killing a neoplastic cell. In some embodiments, the method includes contacting a neoplastic cell expressing an antigen selected from the group consisting of CD5, CD7, CD3, CD33, and CD123, with two or more immune cells, each immune cell expressing a different chimeric antigen receptor that targets two of said antigens expressed by the cell, wherein the immune cell comprise one or more mutations that reduce or eliminate expression of the targeted antigen, and one or more mutations that reduce or eliminate expression of a polypeptide selected from the group consisting of TRAC, LAG-3, FAS, CIITA, TRBC1, TRBC2, CD52, B2M, and PD1. In some embodiments, the method is carried out in vitro or in vivo. In some embodiments, the neoplastic cell is derived from a neoplasia.

In one aspect, the invention provides a method for treating a neoplasia in a subject. In some embodiments, the method includes administering to the subject two or more immune cells, each immune cell expressing a different chimeric antigen receptor that targets an antigen expressed by a neoplastic cell of the subject, selected from the group consisting of CD5, CD7, CD3, CD33, and CD123, wherein the immune cell comprise one or more mutations that reduce or eliminate expression of the antigen, and each of the immune cells further comprise one or more mutations that reduce or eliminate expression of a polypeptide selected from the group consisting of TRAC, LAG-3, FAS, CIITA, TRBC1, TRBC2, CD52, B2M, and PD1.

In some embodiments, the neoplasia is a hematological cancer. In some embodiments, the neoplasia is a liquid cancer. In some embodiments, the hematological cancer is leukemia, myeloma, and/or lymphoma. In some embodiments, the hematological cancer is a B cell cancer. In some embodiments, the hematological cancer is selected from at least one of the following T-cell acute lymphoblastic leukemia (T-ALL), mycosis fungoides (MF), Sézary syndrome (SS), Peripheral T/NK-cell lymphoma, Anaplastic large cell lymphoma ALK⁺, Primary cutaneous T-cell lymphoma, T-cell large granular lymphocytic leukemia, Angioimmunoblastic T/NK-cell lymphoma, Hepatosplenic T-cell lymphoma, Primary cutaneous CD30⁺ lymphoproliferative disorders, Extranodal NK/T-cell lymphoma, Adult T-cell leukemia/lymphoma, T-cell prolymphocytic leukemia, Subcutaneous panniculitis-like T-cell lymphoma, Primary cutaneous gamma-delta T-cell lymphoma, Aggressive NK-cell leukemia, and Enteropathy-associated T-cell lymphoma. In some embodiments, the hematological cancer is a T-cell acute lymphoblastic leukemia (T-ALL) cell. In some embodiments, the hematological cancer is acute myelogenous leukemia (AML).

In another aspect, the invention provides a method for treating a neoplasia in a selected subject. In some embodiments, the method includes administering to the selected subject two or more immune cells, each immune cell expressing a different chimeric antigen receptor that targets an antigen expressed by a neoplastic cell of the subject, wherein the antigen is selected from the group consisting of CD5, CD7, CD3, CD33, and CD123, wherein the immune cell comprise one or more mutations that reduce or eliminate expression of the antigen, and each of the immune cells further comprise one or more mutations that reduce or eliminate expression of a polypeptide selected from the group consisting of TRAC, LAG-3, FAS, CIITA, TRBC1, TRBC2, CD52, B2M, and PD1, wherein the subject is selected as having a neoplasia expressing an antigen selected from the group consisting of CD5, CD7, CD3, CD33, and CD123. In some embodiments, the hematological cancer is a T-cell acute lymphoblastic leukemia (T-ALL) cell. In some embodiments, the hematological cancer is acute myelogenous leukemia (AML). In some embodiments, the two or more immune cells expressing different chimeric antigen receptors are administered sequentially. In some embodiments, the two or more immune cells expressing different chimeric antigen receptors are administered simultaneously.

In yet another aspect, the invention provides a method for the antigen-dependent killing of a neoplastic cell in a subject. In some embodiments, the method includes administering to a subject having a neoplasia expressing an antigen selected from the group consisting of CD5, CD7, CD3, CD33, and CD123, two or more immune cells, each immune cell expressing a different chimeric antigen receptor that targets one of said antigens, wherein the immune cell comprise one or more mutations that reduce or eliminate expression of the targeted antigen, and one or more mutations that reduce or eliminate expression of a polypeptide selected from the group consisting of TRAC, LAG-3, FAS, CIITA, TRBC1, TRBC2, CD52, B2M, and PD1.

In one aspect, the invention provides a method for the antigen-dependent killing of an acute myelogenous leukemia (AML) cell in a subject. In some embodiments, the method includes administering to a subject having AML expressing CD33 and CD123 antigens, two or more immune cells, each immune cell expressing a different chimeric antigen receptor that targets one of said antigens, wherein the immune cell comprise one or more mutations that reduce or eliminate expression of the targeted antigen, and one or more mutations that reduce or eliminate expression of a polypeptide selected from the group consisting of TRAC, LAG-3, FAS, CIITA, TRBC1, TRBC2, CD52, B2M, and PD1.

In one aspect, the invention provides a method for the antigen-dependent killing of a T-cell acute lymphoblastic leukemia (T-ALL) cell in a subject. In some embodiments, the method includes administering to a subject having T-ALL expressing CD3, CD5, and CD7 antigens, at least three immune cells, each immune cell expressing a different chimeric antigen receptor that targets one of said antigens, wherein the immune cell comprise one or more mutations that reduce or eliminate expression of the targeted antigen, and one or more mutations that reduce or eliminate expression of a polypeptide selected from the group consisting of TRAC, LAG-3, FAS, CIITA, TRBC1, TRBC2, CD52, B2M, and PD1.

In another aspect, the invention provides a method for treating cancer in a selected subject. In some embodiments, the method includes administering to the subject at least two immune cells, each immune cell expressing a chimeric antigen receptor that targets CD33 or CD123 antigens, wherein the immune cells comprise one or more mutations that reduce or eliminate expression of the targeted antigen, and one or more mutations that reduce or eliminate expression of a polypeptide selected from the group consisting of TRAC, LAG-3, FAS, CIITA, TRBC1, TRBC2, CD52, B2M, and PD1, wherein the subject is selected by characterizing the cancer as expressing CD33 and CD123 antigens. In some embodiments, the cancer expressing CD33 and CD123 antigens is AML.

In yet another aspect, the invention provides a method for treating cancer in a selected subject. In some embodiments, the method includes administering to the subject three or more immune cells, each immune cell expressing a different chimeric antigen receptor that targets CD3, CD5, and CD7 antigens, wherein the immune cells comprise one or more mutations that reduce or eliminate expression of the targeted antigen, and one or more mutations that reduce or eliminate expression of a polypeptide selected from the group consisting of TRAC, LAG-3, FAS, CIITA, TRBC1, TRBC2, CD52, B2M, and PDT, wherein the subject is selected by characterizing the cancer as expressing CD3, CD5, and CD7 antigens. In some embodiments, the cancer expressing CD3, CD5, and CD7 antigens is T-ALL.

In some embodiments, the immune cells are cytotoxic T cells, regulatory T cells, T helper cells, dendritic cells, B cells, or NK cells. In some embodiments, the subject has been previously treated with lymphodepletion. In some embodiments, the lymphodepletion involves administration of cyclophosphamide, fludarabine, and/or alemtuzumab (Cy/Flu/Campath). In some embodiments, the subject is refractory to chemotherapy or has a high tumor burden. In some embodiments, the subject is subsequently treated with allogeneic hematopoietic stem cell transplantation (allo-HSCT). In some embodiments, the immune cell is derived from a single human donor. In some embodiments, the immune cell is autologous to the subject. In some embodiments, the immune cell is allogenic to the subject. In some embodiments, the subject is a mammalian subject. In some embodiments, the subject is a human or rodent subject. In some embodiments, the subject is a pediatric human subject.

In one aspect, the invention provides a kit including any of the compositions provided herein for use in the treatment of cancer. In another aspect, the invention provides a kit including any of the base editor systems as provided herein for use in generating a CAR-expressing immune cell having reduced immunogenicity. In some embodiments, any of the kits as provided herein include written instructions for the use of the kit.

The description and examples herein illustrate embodiments of the present disclosure in detail. It is to be understood that this disclosure is not limited to the particular embodiments described herein and as such can vary. Those of skill in the art will recognize that there are numerous variations and modifications of this disclosure, which are encompassed within its scope.

The practice of some embodiments disclosed herein employ, unless otherwise indicated, conventional techniques of immunology, biochemistry, chemistry, molecular biology, microbiology, cell biology, genomics and recombinant DNA, which are within the skill of the art. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)).

Although various features of the present disclosure can be described in the context of a single embodiment, the features can also be provided separately or in any suitable combination. Conversely, although the present disclosure can be described herein in the context of separate embodiments for clarity, the present disclosure can also be implemented in a single embodiment. The section headings used herein are for organizational purposes only and are not to be construed as limiting the subject matter described.

The features of the present disclosure are set forth with particularity in the appended claims. A better understanding of the features and advantages of the present will be obtained by reference to the following detailed description that sets forth illustrative embodiments, in which the principles of the disclosure are utilized, and in view of the accompanying drawings as described hereinbelow.

DEFINITIONS

The following definitions supplement those in the art and are directed to the current application and are not to be imputed to any related or unrelated case, e.g., to any commonly owned patent or application. Although any methods and materials similar or equivalent to those described herein can be used in the practice for testing of the present disclosure, the preferred materials and methods are described herein. Accordingly, the terminology used herein is for the purpose of describing particular embodiments only, and is not intended to be limiting.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991).

In this application, the use of the singular includes the plural unless specifically stated otherwise. It must be noted that, as used in the specification, the singular forms "a," "an," and "the" include plural references unless the context clearly dictates otherwise. In this application, the use of "or" means "and/or," unless stated otherwise, and is understood to be inclusive. Furthermore, use of the term "including" as well as other forms, such as "include," "includes," and "included," is not limiting.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

The term "about" or "approximately" means within an acceptable error range for the particular value as determined by one of ordinary skill in the art, which will depend in part on how the value is measured or determined, i.e., the limitations of the measurement system. For example, "about" can mean within one (1) or more than one (1) standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, such as within 5-fold or within 2-fold, of a value. Where particular values are described in the application and claims, unless otherwise stated the term "about" means within an acceptable error range for the particular value should be assumed.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxyadenosine to deoxyinosine. In some embodiments, the adenosine deaminase catalyzes the hydrolytic deamination of adenine or adenosine in deoxyribonucleic acid (DNA). The adenosine deaminases (e.g., engineered adenosine deaminases, evolved adenosine deaminases) provided herein may be from any organism, such as a bacterium.

In some embodiments, the deaminase or deaminase domain is a variant of a naturally-occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, or at least 99.9% identical to a naturally-occurring deaminase. In some embodiments, the adenosine deaminase is from a bacterium, such as, E. coli, S. aureus, B. subtilis, S. typhi, S. putrefaciens, H. influenzae, C. crescentus, or G. sulfurreducens. In some embodiments, the adenosine deaminase is a TadA deaminase. In some embodiments, the TadA deaminase is an E. coli TadA (ecTadA) deaminase or a fragment thereof.

In some embodiments, the ecTadA deaminase is truncated ecTadA. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine. In some embodiments, the TadA deaminase is an N-terminal truncated TadA. In particular embodiments, the TadA is any one of the TadAs described in PCT/US2017/045381, which is incorporated herein by reference in its entirety.

In some embodiments, the TadA deaminase is TadA variant. In some embodiments, the TadA variant is TadA*7.10. In some embodiments, the TadA variant is TadA*8. In some embodiments, the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24. In some embodiments, the TadA*8 is TadA*8a, TadA*8b, TadA*8c, TadA*8d, or TadA*8e. In some embodiments, the TadA*8 is TadA*8e. In some embodiments, the TadA variant is TadA*9.

By "Adenosine Deaminase Base Editor 8 (ABE8) polypeptide" or "ABE8" is meant a base editor as defined herein comprising an adenosine deaminase variant comprising an alteration at amino acid position 82 and/or 166 of the following reference sequence:

```
MSEVEFSHEYWMRHALTLAKRARDEREVPVGAVLVLNNRVIGE

GWNRAIGLHDPTAHAEIMQGGLVMQNYRLIDATLYVTFEPCVM

CAGAMIHSRIGRVVFGVRNAKTGAAGSLMDVLHYPGRVEITEG

ILADECAALLCYFFRMPRQVFNAQKKAQSSTD
```

In some embodiments, ABE8 comprises further alterations, as described herein, relative to the reference sequence.

By "Adenosine Deaminase Base Editor 8 (ABE8) polynucleotide" is meant a polynucleotide encoding an ABE8.

By "Adenosine Deaminase Base Editor 9 (ABE9) poly-peptide" or "ABE9" is meant a base editor as defined herein comprising an adenosine deaminase variant comprising one or more of the following alterations: R21N, R23H, E25F, N38G, L51W, P54C, M70V, Q71M, N72K, Y73S, V82T, M94V, P124W, T133K, D139L, D139M, C146R, and A158K, in the following reference sequence:

```
            10         20         30
     MSEVEFSHEY WMRHALTLAK RARDEREVPV
            40         50         60
     GAVLVLNNRV IGEGWNRAIG LHDPTAHAEI
                   70         80         90
     MALRQGGLVM QNYRLIDATL YVTFEPCVMC
            100        120        130
     AGAMIHSRIG RVVFGVRNAK TGAAGSLMDV
            140        150
     LHYPGMNHRV EITEGILADE CAALLCYFFR
            160
     MPRQVFNAQK KAQSSTD
```

The relevant bases altered in the reference sequence are shown by underlining and bold font. In some embodiments, ABE9 comprises further alterations, as described herein, relative to the reference sequence. Details of ABE9 base editors are described in International PCT Application No. PCT/2020/049975, which is incorporated herein by refer-ence for its entirety.

By "Adenosine Deaminase Base Editor 9 (ABE9) poly-nucleotide" is meant a polynucleotide encoding an ABE9.

"Administering" is referred to herein as providing one or more compositions described herein to a patient or a subject. By way of example and without limitation, composition administration, e.g., injection, can be performed by intrave-nous (i.v.) injection, sub-cutaneous (s.c.) injection, intrad-ermal (i.d.) injection, intraperitoneal (i.p.) injection, or intra-muscular (i.m.) injection. One or more such routes can be employed. Parenteral administration can be, for example, by bolus injection or by gradual perfusion over time. In some embodiments, parenteral administration includes infusing or injecting intravascularly, intravenously, intramuscularly, intraarterially, intrathecally, intratumorally, intradermally, intraperitoneally, transtracheally, subcutaneously, subcuticu-larly, intraarticularly, subcapsularly, subarachnoidly and intrastemally. Alternatively, or concurrently, administration can be by the oral route.

By "agent" is meant any small molecule chemical com-pound, antibody, nucleic acid molecule, or polypeptide, or fragments thereof.

By "alteration" is meant a change (e.g. increase or decrease) in the structure, expression levels or activity of a gene or polypeptide as detected by standard art known methods such as those described herein. As used herein, an alteration (e.g., increase or decrease) includes a change in a polynucleotide or polypeptide sequence or a change in expression levels, such as a 10% change, a 25% change, a 40% change, and a 50% change, or greater.

"Allogeneic," as used herein, refers to cells of the same species that differ genetically to the cell in comparison.

By "ameliorate" is meant decrease, suppress, attenuate, diminish, arrest, or stabilize the development or progression of a disease.

By "analog" is meant a molecule that is not identical, but has analogous functional or structural features. For example, a polynucleotide or polypeptide analog retains the biological activity of a corresponding naturally-occurring polynucle-otide or polypeptide, while having certain modifications that enhance the analog's function relative to a naturally occurring polynucleotide or polypeptide. Such modifications could increase the analog's affinity for DNA, efficiency, specificity, protease or nuclease resistance, membrane per-meability, and/or half-life, without altering, for example, ligand binding. An analog may include an unnatural nucleo-tide or amino acid.

By "anti-neoplasia activity" is meant preventing or inhib-iting the maturation and/or proliferation of neoplasms.

"Autologous," as used herein, refers to cells from the same subject.

As used herein, the term "antibody" refers to an immu-noglobulin molecule that specifically binds to, or is immu-nologically reactive with, a particular antigen, and includes polyclonal, monoclonal, genetically engineered, and other-wise modified forms of antibodies, including but not limited to chimeric antibodies, humanized antibodies, heteroconju-gate antibodies (e.g., bi- tri- and quad-specific antibodies, diabodies, triabodies, and tetrabodies), and antigen binding fragments of antibodies, including, for example, Fab', F(ab') 2, Fab, Fv, rIgG, and scFv fragments. Unless otherwise indicated, the term "monoclonal antibody" (mAb) is meant to include both intact molecules, as well as antibody frag-ments (including, for example, Fab and F(ab')2 fragments) that are capable of specifically binding to a target protein. As used herein, the Fab and F(ab')2 fragments refer to antibody fragments that lack the Fc fragment of an intact antibody. Examples of these antibody fragments are described herein.

By "B cell maturation antigen, or tumor necrosis factor receptor superfamily member 17 polypeptide, (BCMA)" is meant a protein having at least about 85% amino acid sequence identify to NCBI Accession No. NP_001183 or a fragment thereof that is expressed on mature B lymphocytes. An exemplary BCMA polypeptide sequence is provided below.

>NP_001183.2 tumor necrosis factor receptor superfam-ily member 17 [Homo sapiens]

```
>NP_001 183.2 tumor neCrosis faCtor reCeptor
superfamily member 17 [Homo sapiens]
MLQMAGQCSQNEYFDSLLHACIPCQLRCSSNTPPLTCQR

YCNASVTNSVKGTNAILWTCLGLSLIISLAVFVIMFLLR

KINSEPLKDEFKNTGSGLLGMANIDLEKSRTGDEIILPR

GLEYTVEECTCEDCIKSKPKVDSDHCFPLPAMEEGATIL

VTTKTNDYCKSLPAALSATEIEKSISAR
```

This antigen can be targeted in relapsed or refractory multiple myeloma and other hematological neoplasia thera-pies.

By "B cell maturation antigen, or tumor necrosis factor receptor superfamily member 17, (BCMA) polynucleotide" is meant a nucleic acid molecule encoding a BCMA poly-peptide. The BCMA gene encodes a cell surface receptor that recognizes B cell activating factor. An exemplary B2M polynucleotide sequence is provided below.

```
>NM_001192.2 Homo sapiens TNF reCeptor
superfamily member 17 (TNFRSF17), mRNA
AAGACTCAAACTTAGAAACTTGAATTAGATGTGGTATTCAAAT

CCTTAGCTGCCGCGAAGACACAGACAGCCCCCGTAAGAACCCA

CGAAGCAGGCGAAGTTCATTGTTCTCAACATTCTAGCTGCTCT

TGCTGCATTTGCTCTGGAATTCTTGTAGAGATATTACTTGTCC
```

-continued

```
TTCCAGGCTGTTCTTTCTGTAGCTCCCTTGTTTTCTTTTTGTG

ATCATGTTGCAGATGGCTGGGCAGTGCTCCCAAAATGAATATT

TTGACAGTTTGTTGCATGCTTGCATACCTTGTCAACTTCGATG

TTCTTCTAATACTCCTCCTCTAACATGTCAGCGTTATTGTAAT

GCAAGTGTGACCAATTCAGTGAAAGGAACGAATGCGATTCTCT

GGACCTGTTTGGGACTGAGCTTAATAATTTCTTTGGCAGTTTT

CGTGCTAATGTTTTTGCTAAGGAAGATAAACTCTGAACCATTA

AAGGACGAGTTTAAAAACACAGGATCAGGTCTCCTGGGCATGG

CTAACATTGACCTGGAAAAGAGCAGGACTGGTGATGAAATTAT

TCTTCCGAGAGGCCTCGAGTACACGGTGGAAGAATGCACCTGT

GAAGACTGCATCAAGAGCAAACCGAAGGTCGACTCTGACCATT

GCTTTCCACTCCCAGCTATGGAGGAAGGCGCAACCATTCTTGT

CACCACGAAAACGAATGACTATTGCAAGAGCCTGCCAGCTGCT

TTGAGTGCTACGGAGATAGAGAAATCAATTTCTGCTAGGTAAT

TAACCATTTCGACTCGAGCAGTGCCACTTTAAAAATCTTTTGT

CAGAATAGATGATGTGTCAGATCTCTTTAGGATGACTGTATTT

TTCAGTTGCCGATACAGCTTTTTGTCCTCTAACTGTGGAAACT

CTTTATGTTAGATATATTTCTCTAGGTTACTGTTGGGAGCTTA

ATGGTAGAAACTTCCTTGGTTTCATGATTAAACTCTTTTTTTT

CCTGA
```

By "base editor (BE)," or "nucleobase editor (NBE)" is meant an agent that binds a polynucleotide and has nucleobase modifying activity. In one embodiment, the agent binds the polynucleotide at a specific sequence using a nucleic acid programmable DNA binding protein. In another embodiment, the base editor is an enzyme capable of modifying a cytidine base within a nucleic acid molecule (e.g., DNA). In some embodiments, the base editor is capable of deaminating a base within a nucleic acid molecule. In some embodiments, the base editor is capable of deaminating a base within a DNA molecule. In some embodiments, the base editor is capable of deaminating a cytidine in DNA. In some embodiments, the base editor is a fusion protein comprising a cytidine deaminase or an adenosine deaminase. In some embodiments, the base editor is a Cas9 protein fused to a cytidine deaminase or an adenosine deaminase. In some embodiments, the base editor is a Cas9 nickase (nCas9) fused to a cytidine deaminase or an adenosine deaminase. In some embodiments, the base editor is fused to an inhibitor of base excision repair, for example, a UGI domain. In some embodiments, the fusion protein comprises a Cas9 nickase fused to a deaminase and an inhibitor of base excision repair, such as a UGI domain.

In some embodiments, the cytidine deaminase or an or an adenosine deaminase nucleobase editor polypeptide comprising the following domains A-B: NH$_2$-[A-B]-COOH, wherein A comprises a cytidine deaminase domain, an adenosine deaminase domain or an active fragment thereof, and wherein B comprises one or more domains having nucleic acid sequence specific binding activity. In one embodiment, the cytidine or adenosine deaminase Nucleobase Editor polypeptide of the previous aspect contains: NH$_2$-[A$_n$-B$_o$]-COOH, wherein A comprises a cytidine deaminase domain, an adenosine deaminase domain, or an active fragment thereof, wherein n is an integer: 1, 2, 3, 4, or 5; and wherein B comprises a domain having nucleic acid sequence specific binding activity; and wherein o is an integer: 1, 2, 3, 4, or 5. In one embodiment, the polypeptide contains one or more nuclear localization sequences. In one embodiment, the polypeptide contains at least one of said nuclear localization sequences is at the N-terminus or C-terminus. In one embodiment, the polypeptide contains the nuclear localization signal is a bipartite nuclear localization signal. In one embodiment, the polypeptide contains one or more domains linked by a linker.

In some embodiments, the base editor is a cytidine base editor (CBE). In some embodiments, the base editor is an adenosine base editor (ABE). In some embodiments, the base editor is an adenosine base editor (ABE) and a cytidine base editor (CBE). In some embodiments, the base editor is a nuclease-inactive Cas9 (dCas9) fused to an adenosine deaminase. In some embodiments, the Cas9 is a circular permutant Cas9 (e.g., spCas9 or saCas9). Circular permutant Cas9s are known in the art and described, for example, in Oakes et al., Cell 176, 254-267, 2019. In some embodiments, the base editor is fused to an inhibitor of base excision repair, for example, a UGI domain, or a dISN domain. In some embodiments, the fusion protein comprises a Cas9 nickase fused to a deaminase and an inhibitor of base excision repair, such as a UGI or dISN domain. In other embodiments the base editor is an abasic base editor.

In some embodiments, an adenosine deaminase is evolved from TadA. In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. In some embodiments, the base editor is fused to an inhibitor of base excision repair (BER). In some embodiments, the inhibitor of base excision repair is a uracil DNA glycosylase inhibitor (UGI). In some embodiments, the inhibitor of base excision repair is an inosine base excision repair inhibitor.

In some embodiments, base editors are generated by cloning an adenosine deaminase variant (e.g., TadA*7.10) into a scaffold that includes a circular permutant Cas9 (e.g., spCAS9) and a bipartite nuclear localization sequence. In some embodiments, base editors are generated (e.g. ABE8) by cloning an adenosine deaminase variant (e.g., TadA*8) into a scaffold that includes a circular permutant Cas9 (e.g., spCAS9 or saCAS9) and a bipartite nuclear localization sequence. Circular permutant Cas9s are known in the art and described, for example, in Oakes et al., Cell 176, 254-267, 2019.

In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. In some embodiments, the base editor is fused to an inhibitor of base excision repair (BER). In some embodiments, the inhibitor of base excision repair is a uracil DNA glycosylase inhibitor (UGI). In some embodiments, the inhibitor of base excision repair is an inosine base excision repair inhibitor.

Details of base editors are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By way of example, the adenine base editor (ABE) as used in the base editing compositions, systems and methods described herein has the nucleic acid sequence (8877 base pairs), (Addgene, Watertown, M A.; Gaudelli N M, et al., Nature. 2017 Nov. 23; 551(7681):464-471. doi: 10.1038/nature24644; Koblan L W, et al., Nat Biotechnol. 2018 October; 36(9):843-846. doi: 10.1038/nbt.4172.) as provided below. Polynucleotide sequences having at least 95% or greater identity to the ABE nucleic acid sequence are also encompassed.

```
ATATGCCAAGTACGCCCCCTATTGACGTCAATGACGGTAA

ATGGCCCGCCTGGCATTATGCCCAGTACATGACCTTATGG

GACTTTCCTACTTGGCAGTACATCTACGTATTAGTCATCG

CTATTACCATGGTGATGCGGTTTTGGCAGTACATCAATGG

GCGTGGATAGCGGTTTGACTCACGGGGATTTCCAAGTCTC

CACCCCATTGACGTCAATGGGAGTTTGTTTTGGCACCAAA

ATCAACGGGACTTTCCAAAATGTCGTAACAACTCCGCCCC

ATTGACGCAAATGGGCGGTAGGCGTGTACGGTGGGAGGTC

TATATAAGCAGAGCTGGTTTAGTGAACCGTCAGATCCGCT

AGAGATCCGCGGCCGCTAATACGACTCACTATAGGGAGAG

CCGCCACCATGAAACGGACAGCCGACGGAAGCGAGTTCGA

GTCACCAAAGAAGAAGCGGAAAGTCTCTGAAGTCGAGTTT

AGCCACGAGTATTGGATGAGGCACGCACTGACCCTGGCAA

AGCGAGCATGGGATGAAAGAGAAGTCCCCGTGGGCGCCGT

GCTGGTGCACAACAATAGAGTGATCGGAGAGGGATGGAAC

AGGCCAATCGGCCGCCACGACCCTACCGCACACGCAGAGA

TCATGGCACTGAGGCAGGGAGGCCTGGTCATGCAGAATTA

CCGCCTGATCGATGCCACCCTGTATGTGACACTGGAGCCA

TGCGTGATGTGCGCAGGAGCAATGATCCACAGCAGGATCG

GAAGAGTGGTGTTCGGAGCACGGGACGCCAAGACCGGCGC

AGCAGGCTCCCTGATGGATGTGCTGCACCACCCCGGCATG

AACCACCGGGTGGAGATCACAGAGGGAATCCTGGCAGACG

AGTGCGCCGCCCTGCTGAGCGATTTCTTTAGAATGCGGAG

ACAGGAGATCAAGGCCCAGAAGAAGGCACAGAGCTCCACC

GACTCTGGAGGATCTAGCGGAGGATCCTCTGGAAGCGAGA

CACCAGGCACAAGCGAGTCCGCCACACCAGAGAGCTCCGG
```

-continued

```
CGGCTCCTCCGGAGGATCCTCTGAGGTGGAGTTTTCCCAC

GAGTACTGGATGAGACATGCCCTGACCCTGGCCAAGAGGG

CACGCGATGAGAGGGAGGTGCCTGTGGGAGCCGTGCTGGT

GCTGAACAATAGAGTGATCGGCGAGGGCTGGAACAGAGCC

ATCGGCCTGCACGACCCAACAGCCCATGCCGAAATTATGG

CCCTGAGACAGGGCGGCCTGGTCATGCAGAACTACAGACT

GATTGACGCCACCCTGTACGTGACATTCGAGCCTTGCGTG

ATGTGCGCCGGCGCCATGATCCACTCTAGGATCGGCCGCG

TGGTGTTTGGCGTGAGGAACGCAAAAACCGGCGCCGCAGG

CTCCCTGATGGACGTGCTGCACTACCCCGGCATGAATCAC

CGCGTCGAAATTACCGAGGGAATCCTGGCAGATGAATGTG

CCGCCCTGCTGTGCTATTTCTTTCGGATGCCTAGACAGGT

GTTCAATGCTCAGAAGAAGGCCCAGAGCTCCACCGACTCC

GGAGGATCTAGCGGAGGCTCCTCTGGCTCTGAGACACCTG

GCACAAGCGAGAGCGCAACACCTGAAAGCAGCGGGGGCAG

CAGCGGGGGGTCAGACAAGAAGTACAGCATCGGCCTGGCC

ATCGGCACCAACTCTGTGGGCTGGGCCGTGATCACCGACG

AGTACAAGGTGCCCAGCAAGAAATTCAAGGTGCTGGGCAA

CACCGACCGGCACAGCATCAAGAAGAACCTGATCGGAGCC

CTGCTGTTCGACAGCGGCGAAACAGCCGAGGCCACCCGGC

TGAAGAGAACCGCCAGAAGAAGATACACCAGACGGAAGAA

CCGGATCTGCTATCTGCAAGAGATCTTCAGCAACGAGATG

GCCAAGGTGGACGACAGCTTCTTCCACAGACTGGAAGAGT

CCTTCCTGGTGGAAGAGGATAAGAAGCACGAGCGGCACCC

CATCTTCGGCAACATCGTGGACGAGGTGGCCTACCACGAG

AAGTACCCCACCATCTACCACCTGAGAAAGAAACTGGTGG

ACAGCACCGACAAGGCCGACCTGCGGCTGATCTATCTGGC

CCTGGCCCACATGATCAAGTTCCGGGGCCACTTCCTGATC

GAGGGCGACCTGAACCCCGACAACAGCGACGTGGACAAGC

TGTTCATGCAGCTGGTGCAGACCTACAACCAGCTGTTCGA

GGAAAACCCCATCAACGCCAGCGGCGTGGACGCCAAGGCC

ATCCTGTCTGCCAGACTGAGCAAGAGCAGACGGCTGGAAA

ATCTGATCGCCCAGCTGCCCGGCGAGAAGAAGAATGGCCT

GTTCGGAAACCTGATTGCCCTGAGCCTGGGCCTGACCCCC

AACTTCAAGAGCAACTTCGACCTGGCCGAGGATGCCAAAC

TGCAGCTGAGCAAGGACACCTACGACGACGACCTGGACAA

CCTGCTGGCCCAGATCGGCGACCAGTACGCCGACCTGTTT

CTGGCCGCCAAGAACCTGTCCGACGCCATCCTGCTGAGCG

ACATCCTGAGAGTGAACACCGAGATCACCAAGGCCCCCCT

GAGCGCCTCTATGATCAAGAGATACGACGAGCACCACCAG
```

-continued

GACCTGACCCTGCTGAAAGCTCTCGTGCGGCAGCAGCTGC

CTGAGAAGTACAAAGAGATTTTCTTCGACCAGAGCAAGAA

CGGCTACGCCGGCTACATTGACGGCGGAGCCAGCCAGGAA

GAGTTCTACAAGTTCATCAAGCCCATCCTGGAAAAGATGG

ACGGCACCGAGGAACTGCTCGTGAAGCTGAACAGAGAGGA

CCTGCTGCGGAAGCAGCGGACCTTCGACAACGGCAGCATC

CCCCACCAGATCCACCTGGGAGAGCTGCACGCCATTCTGC

GGCGGCAGGAAGATTTTTAGCCATTCCTGAAGGACAACCG

GGAAAAGATCGAGAAGATCCTGACCTTCCGCATCCCCTAC

TACGTGGGCCCTCTGGCCAGGGGAAACAGCAGATTCGCCT

GGATGACCAGAAAGAGCGAGGAAACCATCACCCCCTGGAA

CTTCGAGGAAGTGGTGGACAAGGGCGCTTCCGCCCAGAGC

TTCATCGAGCGGATGACCAACTTCGATAAGAACCTGCCCA

ACGAGAAGGTGCTGCCCAAGCACAGCCTGCTGTACGAGTA

CTTCACCGTGTATAACGAGCTGACCAAAGTGAAATACGTG

ACCGAGGGAATGAGAAAGCCCGCCTTCCTGAGCGGCGAGC

AGAAAAAGGCCATCGTGGACCTGCTGTTCAAGACCAACCG

GAAAGTGACCGTGAAGCAGCTGAAAGAGGACTACTTCAAG

AAAATCGAGTGCTTCGACTCCGTGGAAATCTCCGGCGTGG

AAGATCGGTTCAACGCCTCCCTGGGCACATACCACGATCT

GCTGAAAATTATCAAGGACAAGGACTTCCTGGACAATGAG

GAAAACGAGGACATTCTGGAAGATATCGTGCTGACCCTGA

CACTGTTTGAGGACAGAGAGATGATCGAGGAACGGCTGAA

AACCTATGCGCACCTGTTCGACGACAAAGTGATGAAGCAG

CTGAAGCGGCGGAGATACACCGGCTGGGGCAGGCTGAGCC

GGAAGCTGATCAACGGCATCCGGGACAAGCAGTCCGGCAA

GACAATCCTGGATTTCCTGAAGTCCGACGGCTTCGCCAAC

AGAAACTTCATGCAGCTGATCCACGACGACAGCCTGACCT

TTAAAGAGGACATCCAGAAAGCCCAGGTGTCCGGCCAGGG

CGATAGCCTGCACGAGCACATTGCCAATCTGGCCGGCAGC

CCCGCCATTAAGAAGGGCATCCTGCAGACAGTGAAGGTGG

TGGACGAGCTCGTGAAAGTGATGGGCCGGCACAAGCCCGA

GAACATCGTGATCGAAATGGCCAGAGAGAACCAGACCACC

CAGAAGGGACAGAAGAACAGCCGCGAGAGAATGAAGCGGA

TCGAAGAGGGCATCAAAGAGCTGGGCAGCCAGATCCTGAA

AGAACACCCCGTGGAAAACACCCAGCTGCAGAACGAGAAG

CTGTACCTGTACTACCTGCAGAATGGGCGGGATATGTACG

TGGACCAGGAACTGGACATCAACCGGCTGTCCGACTACGA

TGTGGACCATATCGTGCCTCAGAGCTTTCTGAAGGACGAC

TCCATCGACAACAAGGTGCTGACCAGAAGCGACAAGAACC

GGGGCAAGAGCGACAACGTGCCCTCCGAAGAGGTCGTGAA

-continued

GAAGATGAAGAACTACTGGCGGCAGCTGCTGAACGCCAAG

CTGATTACCCAGAGAAAGTTCGACAATCTGACCAAGGCCG

AGAGAGGCGGCCTGAGCGAACTGGATAAGGCCGGCTTCAT

CAAGAGACAGCTGGTGGAAACCCGGCAGATCACAAAGCAC

GTGGCACAGATCCTGGACTCCCGGATGAACACTAAGTACG

ACGAGAATGACAAGCTGATCCGGGAAGTGAAAGTGATCAC

CCTGAAGTCCAAGCTGGTGTCCGATTTCCGGAAGGATTTC

CAGTTTTACAAAGTGCGCGAGATCAACAACTACCACCACG

CCCACGACGCCTACCTGAACGCCGTCGTGGGAACCGCCCT

GATCAAAAAGTACCCTAAGCTGGAAAGGGAGTTCGTGTAC

GGCGACTACAAGGTGTACGACGTGCGGAAGATGATCGCCA

AGAGCGAGCAGGAAATCGGCAAGGCTACCGCCAAGTACTT

CTTCTACAGCAACATCATGAACTTTTTCAAGACCGAGATT

ACCCTGGCCAACGGCGAGATCCGGAAGCGGCCTCTGATCG

AGACAAACGGCGAAACCGGGGAGATCGTGTGGGATAAGGG

CCGGGATTTTGCCACCGTGCGGAAAGTGCTGAGCATGCCC

CAAGTGAATATCGTGAAAAAGACCGAGGTGCAGACAGGCG

GCTTCAGCAAAGAGTCTATCCTGCCCAAGAGGAACAGCGA

TAAGCTGATCGCCAGAAAGAAGGACTGGGACCCTAAGAAG

TACGGCGGCTTCGACAGCCCCACCGTGGCCTATTCTGTGC

TGGTGGTGGCCAAAGTGGAAAAGGGCAAGTCCAAGAAACT

GAAGAGTGTGAAAGAGCTGCTGGGGATCACCATCATGGAA

AGAAGCAGCTTCGAGAAGAATCCCATCGACTTTCTGGAAG

CCAAGGGCTACAAAGAAGTGAAAAAGGACCTGATCATCAA

GCTGCCTAAGTACTCCCTGTTCGAGCTGGAAAACGGCCGG

AAGAGAATGCTGGCCTCTGCCGGCGAACTGCAGAAGGGAA

ACGAACTGGCCCTGCCCTCCAAATATGTGAACTTCCTGTA

CCTGGCCAGCCACTATGAGAAGCTGAAGGGCTCCCCCGAG

GATAATGAGCAGAAACAGCTGTTTGTGGAACAGCACAAGC

ACTACCTGGACGAGATCATCGAGCAGATCAGCGAGTTCTC

CAAGAGAGTGATCCTGGCCGACGCTAATCTGGACAAAGTG

CTGTCCGCCTACAACAAGCACCGGGATAAGCCCATCAGAG

AGCAGGCCGAGAATATCATCCACCTGTTTACCCTGACCAA

TCTGGGAGCCCCTGCCGCCTTCAAGTACTTTGACACCACC

ATCGACCGGAAGAGGTACACCAGCACCAAAGAGGTGCTGG

ACGCCACCCTGATCCACCAGAGCATCACCGGCCTGTACGA

GACACGGATCGACCTGTCTCAGCTGGGAGGTGACTCTGGC

GGCTCAAAAAGAACCGCCGACGGCAGCGAATTCGAGCCCA

AGAAGAAGAGGAAAGTCTAACCGGTCATCATCACCATCAC

CATTGAGTTTAAACCCGCTGATCAGCCTCGACTGTGCCTT

-continued

```
CTAGTTGCCAGCCATCTGTTGTTTGCCCCTCCCCCGTGCC

TTCCTTGACCCTGGAAGGTGCCACTCCCACTGTCCTTTCC

TAATAAAATGAGGAAATTGCATCGCATTGTCTGAGTAGGT

GTCATTCTATTCTGGGGGGTGGGGTGGGGCAGGACAGCAA

GGGGGAGGATTGGGAAGACAATAGCAGGCATGCTGGGGAT

GCGGTGGGCTCTATGGCTTCTGAGGCGGAAAGAACCAGCT

GGGGCTCGATACCGTCGACCTCTAGCTAGAGCTTGGCGTA

ATCATGGTCATAGCTGTTTCCTGTGTGAAATTGTTATCCG

CTCACAATTCCACACAACATACGAGCCGGAAGCATAAAGT

GTAAAGCCTAGGGTGCCTAATGAGTGAGCTAACTCACATT

AATTGCGTTGCGCTCACTGGCCGCTTTCCAGTCGGGAAAC

CTGTCGTGCCAGCTGCATTAATGAATCGGCCAACGCGCGG

GGAGAGGCGGTTTGCGTATTGGGCGCTCTTCCGCTTCCTC

GCTCACTGACTCGCTGCGCTCGGTCGTTCGGCTGCGGCGA

GCGGTATCAGCTCACTCAAAGGCGGTAATACGGTTATCCA

CAGAATCAGGGGATAACGCAGGAAAGAACATGTGAGCAAA

AGGCCAGCAAAAGGCCAGGAACCGTAAAAAGGCCGCGTTG

CTGGCGTTTTTCCATAGGCTCCGCCCCCCTGACGAGCATC

ACAAAAATCGACGCTCAAGTCAGAGGTGGCGAAACCCGAC

AGGACTATAAAGATACCAGGCGTTTCCCCCTGGAAGCTCC

CTCGTGCGCTCTCCTGTTCCGACCCTGCCGCTTACCGGAT

ACCTGTCCGCCTTTCTCCCTTCGGGAAGCGTGGCGCTTTC

TCATAGCTCACGCTGTAGGTATCTCAGTTCGGTGTAGGTC

GTTCGCTCCAAGCTGGGCTGTGTGCACGAACCCCCCGTTC

AGCCCGACCGCTGCGCCTTATCCGGTAACTATCGTCTTGA

GTCCAACCCGGTAAGACACGACTTATCGCCACTGGCAGCA

GCCACTGGTAACAGGATTAGCAGAGCGAGGTATGTAGGCG

GTGCTACAGAGTTCTTGAAGTGGTGGCCTAACTACGGCTA

CACTAGAAGAACAGTATTTGGTATCTGCGCTCTGCTGAAG

CCAGTTACCTTCGGAAAAAGAGTTGGTAGCTCTTGATCCG

GCAAACAAACCACCGCTGGTAGCGGTGGTTTTTTGTTTG

CAAGCAGCAGATTACGCGCAGAAAAAAAGGATCTCAAGAA

GATCCTTTGATCTTTTCTACGGGGTCTGACACTCAGTGGA

ACGAAAACTCACGTTAAGGGATTTTGGTCATGAGATTATC

AAAAAGGATCTTCACCTAGATCCTTTTAAATTAAAAATGA

AGTTTTAAATCAATCTAAAGTATATATGAGTAAACTTGGT

CTGACAGTTACCAATGCTTAATCAGTGAGGCACCTATCTC

AGCGATCTGTCTATTTCGTTCATCCATAGTTGCCTGACTC

CCCGTCGTGTAGATAACTACGATACGGGAGGGCTTACCAT

CTGGCCCCAGTGCTGCAATGATACCGCGAGACCCACGCTC

ACCGGCTCCAGATTTATCAGCAATAAACCAGCCAGCCGGA
```

-continued

```
AGGGCCGAGCGCAGAAGTGGTCCTGCAACTTTATCCGCCT

CCATCCAGTCTATTAATTGTTGCCGGGAAGCTAGAGTAAG

TAGTTCGCCAGTTAATAGTTTGCGCAACGTTGTTGCCATT

GCTACAGGCATCGTGGTGTCACGCTCGTCGTTTGGTATGG

CTTCATTCAGCTCCGGTTCCCAACGATCAAGGCGAGTTAC

ATGATCCCCATGTTGTGCAAAAAAGCGGTTAGCTCCTTC

GGTCCTCCGATCGTTGTCAGAAGTAAGTTGGCCGCAGTGT

TATCACTCATGGTTATGGCAGCACTGCATAATTCTCTTAC

TGTCATGCCATCCGTAAGATGCTTTTCTGTGACTGGTGAG

TACTCAACCAAGTCATTCTGAGAATAGTGTATGCGGCGAC

CGAGTTGCTCTTGCCCGGCGTCAATACGGGATAATACCGC

GCCACATAGCAGAACTTTAAAAGTGCTCATCATTGGAAAA

CGTTCTTCGGGGCGAAAACTCTCAAGGATCTTACCGCTGT

TGAGATCCAGTTCGATGTAACCCACTCGTGCACCCAACTG

ATCTTCAGCATCTTTTACTTTCACCAGCGTTTCTGGGTGA

GCAAAAACAGGAAGGCAAAATGCCGCAAAAAAGGGAATAA

GGGCGACACGGAAATGTTGAATACTCATACTCTTCCTTTT

TCAATATTATTGAAGCATTTATCAGGGTTATTGTCTCATG

AGCGGATACATATTTGAATGTATTTAGAAAAATAAACAAA

TAGGGGTTCCGCGCACATTTCCCCGAAAAGTGCCACCTGA

CGTCGACGGATCGGGAGATCGATCTCCCGATCCCCTAGGG

TCGACTCTCAGTACAATCTGCTCTGATGCCGCATAGTTAA

GCCAGTATCTGCTCCCTGCTTGTGTGTTGGAGGTCGCTGA

GTAGTGCGCGAGCAAAATTTAAGCTACAACAAGGCAAGGC

TTGACCGACAATTGCATGAAGAATCTGCTTAGGGTTAGGC

GTTTTGCGCTGCTTCGCGATGTACGGGCCAGATATACGCG

TTGACATTGATTATTGACTAGTTATTAATAGTAATCAATT

ACGGGGTCATTAGTTCATAGCCCATATATGGAGTTCCGCG

TTACATAACTTACGGTAAATGGCCCGCCTGGCTGACCGCC

CAACGACCCCCGCCCATTGACGTCAATAATGACGTATGTT

CCCATAGTAACGCCAATAGGGACTTTCCATTGACGTCAAT

GGGTGGAGTATTTACGGTAAACTGCCCACTTGGCAGTACA

TCAAGTGTATC
```

In some embodiments, the base editor is an Adenosine Deaminase Base Editor 8 (ABE8). In some embodiments, the ABE8 is selected from a base editor from Table 13, 14 or 16 infra. In some embodiments, ABE8 contains an adenosine deaminase variant evolved from TadA. In some embodiments, the adenosine deaminase variant of ABE8 is a TadA*8 variant as described in Table 11, 13 or 14 infra. In some embodiments, the adenosine deaminase variant is TadA*7.10 variant (e.g., TadA*8) comprising one or more of an alteration selected from the group of Y147T, Y147R, Q154S, Y123H, V82S, T166R, and/or Q154R. In various embodiments, ABE8 comprises TadA*7.10 variant (e.g., TadA*8) with a combination of alterations selected from the group of: Y147T+Q154R; Y147T+Q154S; Y147R+Q154S;

V82S+Q154S; V82S+Y147R; V82S+Q154R; V82S+
Y123H; I76Y+V82S; V82S+Y123H+Y147T; V82S+
Y123H+Y147R; V82S+Y123H+Q154R; Y147R+Q154R+
Y123H; Y147R+Q154R+I76Y; Y147R+Q154R+T166R;
Y123H+Y147R+Q154R+I76Y; V82S+Y123H+Y147R+ 5
Q154R; and I76Y+V82S+Y123H+Y147R+Q154R. In some
embodiments ABE8 is a monomeric construct. In some
embodiments, ABE8 is a heterodimeric construct. In some
embodiments, the ABE8 base editor comprises the
sequence:

```
MSEVEFSHEYWMRHALTLAKRARDEREVPVGAVLVLNNRV

IGEGWNRAIGLHDPTAHAEIMALRQGGLVMQNYRLIDATL
```

-continued

```
YVTFEPCVMCAGAMIHSRIGRVVFGVRNAKTGAAGSLMDV

LHYPGMNHRVEITEGILADECAALLCTFFRMPRQVFNAQK

KAQSSTD.
```

By way of example, a cytidine base editor (CBE) as used
in the base editing compositions, systems and methods
described herein has the following nucleic acid sequence
(8877 base pairs), (Addgene, Watertown, M A.; Komor A C,
et al., 2017, Sci Adv., 30; 3(8):eaao4774. doi: 10.1126/
sciadv.aao4774) as provided below. Polynucleotide
sequences having at least 95% or greater identity to the BE4
nucleic acid sequence are also encompassed.

```
   1 ATATGCCAAG TACGCCCCCT ATTGACGTCA ATGACGGTAA ATGGCCCGCC TGGCATTATG

61 CCCAGTACAT GACCTTATGG GACTTTCCTA CTTGGCAGTA CATCTACGTA TTAGTCATCG

121 CTATTACCAT GGTGATGCGG TTTTGGCAGT ACATCAATGG GCGTGGATAG CGGTTTGACT

181 CACGGGGATT TCCAAGTCTC CACCCCATTG ACGTCAATGG GAGTTTGTTT TGGCACCAAA

241 ATCAACGGGA CTTTCCAAAA TGTCGTAACA ACTCCGCCCC ATTGACGCAA ATGGGCGGTA

301 GGCGTGTACG GTGGGAGGTC TATATAAGCA GAGCTGGTTT AGTGAACCGT CAGATCCGCT

361 AGAGATCCGC GGCCGCTAAT ACGACTCACT ATAGGGAGAG CCGCCACCAT GAGCTCAGAG

421 ACTGGCCCAG TGGCTGTGGA CCCCACATTG AGACGGCGGA TCGAGCCCCA TGAGTTTGAG

481 GTATTCTTCG ATCCGAGAGA GCTCCGCAAG GAGACCTGCC TGCTTTACGA AATTAATTGG

541 GGGGGCCGGC ACTCCATTTG GCGACATACA TCACAGAACA CTAACAAGCA CGTCGAAGTC

601 AACTTCATCG AGAAGTTCAC GACAGAAAGA TATTTCTGTC CGAACACAAG GTGCAGCATT

661 ACCTGGTTTC TCAGCTGGAG CCCATGCGGC GAATGTAGTA GGGCCATCAC TGAATTCCTG

721 TCAAGGTATC CCCACGTCAC TCTGTTTATT TACATCGCAA GGCTGTACCA CCACGCTGAC

781 CCCCGCAATC GACAAGGCCT GCGGGATTTG ATCTCTTCAG GTGTGACTAT CCAAATTATG

841 ACTGAGCAGG AGTCAGGATA CTGCTGGAGA AACTTTGTGA ATTATAGCCC GAGTAATGAA

901 GCCCACTGGC CTAGGTATCC CCATCTGTGG GTACGACTGT ACGTTCTTGA ACTGTACTGC

961 ATCATACTGG GCCTGCCTCC TTGTCTCAAC ATTCTGAGAA GGAAGCAGCC ACAGCTGACA

1021 TTCTTTACCA TCGCTCTTCA GTCTTGTCAT TACCAGCGAC TGCCCCCACA CATTCTCTGG

1081 GCCACCGGGT TGAAATCTGG TGGTTCTTCT GGTGGTTCTA GCGGCAGCGA GACTCCCGGG

1141 ACCTCAGAGT CCGCCACACC CGAAAGTTCT GGTGGTTCTT CTGGTGGTTC TGATAAAAAG

1201 TATTCTATTG GTTTAGCCAT CGGCACTAAT TCCGTTGGAT GGGCTGTCAT AACCGATGAA

1261 TACAAAGTAC CTTCAAAGAA ATTTAAGGTG TTGGGGAACA CAGACCGTCA TTCGATTAAA

1321 AAGAATCTTA TCGGTGCCCT CCTATTCGAT AGTGGCGAAA CGGCAGAGGC GACTCGCCTG

1381 AAACGAACCG CTCGGAGAAG GTATACACGT CGCAAGAACC GAATATGTTA CTTACAAGAA

1441 ATTTTTAGCA ATGAGATGGC CAAAGTTGAC GATTCTTTCT TCCACCGTTT GGAAGAGTCC

1501 TTCCTTGTCG AAGAGGACAA GAAACATGAA CGGCACCCCA TCTTTGGAAA CATAGTAGAT

1561 GAGGTGGCAT ATCATGAAAA GTACCCAACG ATTTATCACC TCAGAAAAAA GCTAGTTGAC

1621 TCAACTGATA AAGCGGACCT GAGGTTAATC TACTTGGCTC TTGCCCATAT GATAAAGTTC

1681 CGTGGGCACT TTCTCATTGA GGGTGATCTA AATCCGGACA ACTCGGATGT CGACAAACTG

1741 TTCATCCAGT TAGTACAAAC CTATAATCAG TTGTTTGAAG AGAACCCTAT AAATGCAAGT
```

27                                                                                                    28

```
1801 GGCGTGGATG CGAAGGCTAT TCTTAGCGCC CGCCTCTCTA AATCCCGACG GCTAGAAAAC

1861 CTGATCGCAC AATTACCCGG AGAGAAGAAA AATGGGTTGT TCGGTAACCT TATAGCGCTC

1921 TCACTAGGCC TGACACCAAA TTTTAAGTCG AACTTCGACT TAGCTGAAGA TGCCAAATTG

1981 CAGCTTAGTA AGGACACGTA CGATGACGAT CTCGACAATC TACTGGCACA AATTGGAGAT

2041 CAGTATGCGG ACTTATTTTT GGCTGCCAAA AACCTTAGCG ATGCAATCCT CCTATCTGAC

2101 ATACTGAGAG TTAATACTGA GATTACCAAG GCGCCGTTAT CCGCTTCAAT GATCAAAAGG

2161 TACGATGAAC ATCACCAAGA CTTGACACTT CTCAAGGCCC TAGTCCGTCA GCAACTGCCT

2221 GAGAAATATA AGGAAATATT CTTTGATCAG TCGAAAAACG GGTACGCAGG TTATATTGAC

2281 GGCGGAGCGA GTCAAGAGGA ATTCTACAAG TTTATCAAAC CCATATTAGA GAAGATGGAT

2341 GGGACGGAAG AGTTGCTTGT AAAACTCAAT CGCGAAGATC TACTGCGAAA GCAGCGGACT

2401 TTCGAGAACG GTAGCATTCC ACATCAAATC CACTTAGGCG AATTGCATGC TATACTTAGA

2461 AGGCAGGAGG ATTTTTATCC GTTCCTCAAA GACAATCGTG AAAAGATTGA GAAAATCCTA

2521 ACCTTTCGCA TACCTTACTA TGTGGGACCC CTGGCCCGAG GGAACTCTCG GTTCGCATGG

2581 ATGACAAGAA AGTCCGAAGA AACGATTACT CCATGGAATT TTGAGGAAGT TGTCGATAAA

2641 GGTGCGTCAG CTCAATCGTT CATCGAGAGG ATGACCAACT TTGACAAGAA TTTACCGAAC

2701 GAAAAAGTAT TGCCTAAGCA CAGTTTACTT TACGAGTATT TCACAGTGTA CAATGAACTC

2751 ACGAAAGTTA AGTATGTCAC TGAGGG+ATG CGTAAACCCG CCTTTCTAAG CGGAGAACAG

2821 AAGAAAGCAA TAGTAGATCT GTTATTCAAG ACCAACCGCA AAGTGACAGT TAAGCAATTG

2881 AAAGAGGACT ACTTTAAGAA AATTGAATGC TTCGATTCTG TCGAGATCTC CGGGGTAGAA

2941 GATCGATTTA ATGCGTCACT TGGTACGTAT CATGACCTCC TAAAGATAAT TAAAGATAAG

3001 GACTTCCTGG ATAACGAAGA GAATGAAGAT ATCTTAGAAG ATATAGTGTT GACTCTTACC

3061 CTCTTTGAAG ATCGGGAAAT GATTGAGGAA AGACTAAAAA CATACGCTCA CCTGTTCGAC

3121 GATAAGGTTA TGAAACAGTT AAAGAGGCGT CGCTATACGG GCTGGGGACG ATTGTCGCGG

3181 AAACTTATCA ACGGGATAAG AGACAAGCAA AGTGGTAAAA CTATTCTCGA TTTTCTAAAG

3241 AGCGACGGCT TCGCCAATAG GAACTTTATG GAGCTGATCC ATGATGACTC TTTAACCTTC

3301 AAAGAGGATA TACAAAAGGC ACAGGTTTCC GGACAAGGGG ACTCATTGCA CGAACATATT

3361 GCGAATCTTG CTGGTTCGCC AGCCATCAAA AAGGGCATAC TCCAGACAGT CAAAGTAGTG

3421 GATGAGCTAG TTAAGGTCAT GGGACGTCAC AAACCGGAAA ACATTGTAAT CGAGATGGCA

3481 CGCGAAAATC AAACGACTCA GAAGGGGCAA AAAAACAGTC GAGAGCGGAT GAAGAGAATA

3541 GAAGAGGGTA TTAAAGAACT GGGCAGCCAG ATCTTAAAGG AGCATCCTGT GGAAAATACC

3601 CAATTGCAGA ACGAGAAACT TTACCTCTAT TACCTACAAA ATGGAAGGGA CATGTATGTT

3661 GATCAGGAAC TGGACATAAA CCGTTTATCT GATTACGACG TCGATCACAT TGTACCCCAA

3721 TCCTTTTTGA AGGACGATTC AATCGACAAT AAAGTGCTTA CACGCTCGGA TAAGAACCGA

3781 GGGAAAAGTG ACAATGTTCC AAGCGAGGAA GTCGTAAAGA AAATGAAGAA CTATTGGCGG

3841 GAGCTCCTAA ATGCGAAACT GATAACGCAA AGAAAGTTCG ATAACTTAAC TAAAGCTGAG

3901 AGGGGTGGCT TGTCTGAACT TGACAAGGCC GGATTTATTA AAggTCAGCT CGTGGAAAgC

3961 CGCCAAATCA CAAAGCATGT TGCACAGATA CTAGATTCCC GAATGAATAC GAAATACGAC

4021 GAGAACGATA AGCTGATTCG GGAAGTCAAA GTAATCACTT TAAAGTCAAA ATTGGTGTCG

4081 GACTTCAGAA AGGATTTTCA ATTCTATAAA GTTAGGGAGA TAAATAACTA CCACCATGCG

4141 CACGACGCTT ATCTTAATGC CGTCGTAGGG ACCGCACTCA TTAAGAAATA CCCGAAGCTA

4201 GAAAGTGAGT TTGTGTATGG TGATTACAAA GTTTATGACG TCCGTAAGAT GATCGCGAAA
```

-continued

```
4261 AGCGAACAGG AGATAGGCAA GGCTACAGCC AAATACTTCT TTTATTCTAA CATTATGAAT

4321 TTCTTTAAGA CGGAAATCAC TCTGGCAAAC GGAGAGATAC GCAAACGACC TTTAATTGAA

4381 ACCAATGGGG AGACAGGTGA AATCGTATGG GATAAGGGCC GGGACTTCGC GACGGTGAGA

4441 AAAGTTTTGT CCATGCCCCA AGTCAACATA GTAAAGAAAA CTGAGGTGCA GACCGGAGGG

4501 TTTTCAAAGG AATCGATTCT TCCAAAAAGG AATAGTGATA AGCTCATCGC TCGTAAAAAG

4561 GACTGGGACC CGAAAAAGTA CGGTGGCTTC GATAGCCCTA CAGTTGCCTA TTCTGTCCTA

4621 GTAGTGGCAA AAGTTGAGAA GGGAAAATCC AAGAAACTGA AGTCAGTCAA AGAATTATTG

4681 GGGATAACGA TTATGGAGCG CTCGTCTTTT GAAAAGAACC CCATCGACTT CCTTGAGGCG

4741 AAAGGTTACA AGGAAGTAAA AAAGGATCTC ATAATTAAAC TACCAAAGTA TAGTCTGTTT

4801 GAGTTAGAAA ATGGCCGAAA ACGGATGTTG GCTAGCGCCG GAGAGCTTCA AAAGGGGAAC

4861 GAACTCGCAC TACCGTCTAA ATACGTGAAT TTCCTGTATT TAGCGTCCCA TTACGAGAAG

4921 TTGAAAGGTT CACCTGAAGA TAACGAACAG AAGCAACTTT TTGTTGAGCA GCACAAACAT

4981 TATCTCGACG AAATCATAGA GCAAATTTCG GAATTCAGTA AGAGAGTCAT CCTAGCTGAT

5041 GCCAATCTGG ACAAAGTATT AAGCGCATAC AACAAGCACA GGGATAAACC CATACGTGAG

5101 CAGGCGGAAA ATATTATCCA TTTGTTTACT CTTACCAACC TCGGCGCTCC AGCCGCATTC

5161 AAGTATTTTG ACACAACGAT AGATCGCAAA CGATACACTT CTACCAAGGA GGTGCTAGAC

5221 GCGACACTGA TTCACCAATC CATCACGGGA TTATATGAAA CTCGGATAGA TTTGTCACAG

5281 CTTGGGGGTG ACTCTGGTGG TTCTGGAAGA TCTGGTGGTT CTACTAATCT GTCAGATATT

5341 ATTGAAAAGG AGACCGGTAA GCAACTGGTT ATCCAGGAAT CCATCCTCAT GCTCCCAGAG

5401 GAGGTGGAAG AAGTCATTGG GAACAAGCCG GAAAGCGATA TACTCGTGCA CACCGCCTAC

5461 GACGAGAGCA CCGACGAGAA TGTCATGCTT CTGACTAGCG ACGCCCCTGA ATAGAAGCCT

5521 TGGGCTCTGG TCATACAGGA TAGCAACGGT GAGAACAAGA TTAAGATGCT CTCTGGTGGT

5581 TCTGGAGGAT CTGGTGGTTC TACTAATCTG TCAGATATTA TTGAAAAGGA GACCGGTAAG

5641 CAACTGGTTA TCCAGGAATC CATCCTCATG CTCCCAGAGG AGGTGGAAGA AGTCATTGGG

5701 AACAAGCCGG AAAGCGATAT ACTCGTGCAC ACCGCCTACG ACGAGAGCAC CGACGAGAAT

5761 GTCATGCTTC TGACTAGCGA CGCCCCTGAA TACAAGCCTT GGGCTCTGGT CATACAGGAT

5821 AGCAACGGTG AGAACAAGAT TAAGATGCTC TCTGGTGGTT CTCCCAAGAA GAAGAGGAAA

5881 GTCTAACCGG TCATCATCAC CATCACCATT GAGTTTAAAC CCGCTGATCA GCCTCGACTG

5941 TGCCTTCTAG TTGCCAGCCA TCTGTTGTTT GCCCCTCCCC CGTGCCTTCC TTGACCCTGG

6001 AAGGTGCCAC TCCCACTGTC CTTTCCTAAT AAAATGAGGA AATTGCATCG CATTGTCTGA

6061 GTAGGTGTCA TTCTATTCTG GGGGGTGGGG TGGGGCAGGA CAGCAAGGGG GAGGATTGGG

6121 AAGACAATAG CAGGCATGCT GGGGATGCGG TGGGCTCTAT GGCTTCTGAG GCGGAAAGAA

6181 CCAGCTGGGG CTCGATACCG TCGACCTCTA GCTAGAGCTT GGCGTAATCA TGGTCATAGC

6241 TGTTTCCTGT GTGAAATTGT TATCCGCTCA CAATTCCACA CAACATACGA GCCGGAAGCA

6301 TAAAGTGTAA AGCCTAGGGT GCCTAATGAG TGAGCTAACT CACATTAATT GCGTTGCGCT

6361 CACTGCCCGC TTTCCAGTCG GGAAACCTGT CGTGCCAGCT GCATTAATGA ATCGGCCAAC

6421 GCGCGGGGAG AGGCGGTTTG CGTATTGGGC GCTCTTCCGC TTCCTCGCTC ACTGACTCGC

6481 TGCGCTCGGT CGTTCGGCTG CGGCGAGCGG TATCAGCTCA CTCAAAGGCG GTAATACGGT

6541 TATCCACAGA ATCAGGGGAT AACGCAGGAA AGAACATGTG AGCAAAAGGC CAGCAAAAGG

6601 CCAGGAACCG TAAAAAGGCC GCGTTGCTGG CGTTTTTCCA TAGGCTCCGC CCCCCTGACG
```

-continued

```
6661 AGCATCACAA AAATCGACGC TCAAGTCAGA GGTGGCGAAA CCCGACAGGA CTATAAAGAT

6721 ACCAGGCGTT TCCCCCTGGA AGCTCCCTCG TGCGCTCTCC TGTTCCGACC CTGCCGCTTA

6781 CCGGATACCT GTCCGCCTTT CTCCCTTCGG GAAGCGTGGC GCTTTCTCAT AGCTCACGCT

6841 GTAGGTATCT CAGTTCGGTG TAGGTCGTTC GCTCCAAGCT GGGCTGTGTG CACGAACCCC

6901 CCGTTCAGCC CGACCGCTGC GCCTTATCCG GTAACTATCG TCTTGAGTCC AACCCGGTAA

6961 GACACGACTT ATCGCCACTG GCAGCAGCCA CTGGTAACAG GATTAGCAGA GCGAGGTATG

7021 TAGGCGGTGC TACAGAGTTC TTGAAGTGGT GGCCTAACTA CGGCTACACT AGAAGAACAG

7081 TATTTGGTAT CTGCGCTCTG CTGAAGCCAG TTACCTTCGG AAAAAGAGTT GGTAGCTCTT

7141 GATCCGGCAA ACAAACCACC GCTGGTAGCG GTGGTTTTTT TGTTTGCAAG CAGCAGATTA

7201 CGCGCAGAAA AAAAGGATCT CAAGAAGATC CTTTGATCTT TTCTACGGGG TCTGACGCTC

7261 AGTGGAACGA AAACTCACGT TAAGGGATTT TGGTCATGAG ATTATCAAAA AGGATCTTCA

7321 CCTAGATCCT TTTAAATTAA AAATGAAGTT TTAAATCAAT CTAAAGTATA TATGAGTAAA

7381 CTTGGTCTGA CAGTTACCAA TGCTTAATCA GTGAGGCACC TATCTCAGCG ATCTGTCTAT

7441 TTCGTTCATC CATAGTTGCC TGACTCCCCG TCGTGTAGAT AACTACGATA CGGGAGGGCT

7501 TACCATCTGG CCCCAGTGCT GCAATGATAC CGCGAGACCC ACGCTCACCG GCTCCAGATT

7561 TATCAGCAAT AAACCAGCCA GCCGGAAGGG CCGAGCGCAG AAGTGGTCCT GCAACTTTAT

7621 CCGCCTCCAT CCAGTCTATT AATTGTTGCC GGGAAGCTAG AGTAAGTAGT TCGCCAGTTA

7681 ATAGTTTGCG CAACGTTGTT GCCATTGCTA CAGGCATCGT GGTGTCACGC TCGTCGTTTG

7741 GTATGGCTTC ATTCAGCTCC GGTTCCCAAC GATCAAGGCG AGTTACATGA TCCCCCATGT

7801 TGTGCAAAAA AGCGGTTAGC TCCTTCGGTC CTCCGATCGT TGTCAGAAGT AAGTTGGCCG

7861 GAGTGTTATC ACTCATGGTT ATGGCAGCAC TGCATAATTC TCTTACTGTC ATGCCATCCG

7921 TAAGATGCTT TTCTGTGACT GGTGAGTACT CAACCAAGTC ATTCTGAGAA TAGTGTATGC

7981 GGCGACCGAG TTGCTCTTGC CCGGCGTCAA TACGGGATAA TACCGCGCCA CATAGGAGAA

8041 CTTTAAAAGT GCTCATCATT GGAAAACGTT CTTCGGGGCG AAAACTCTGA AGGATCTTAC

8101 CGCTGTTGAG ATCCAGTTCG ATGTAACCCA CTCGTGCACC CAACTGATCT TCAGCATCTT

8161 TTACTTTCAC CAGCGTTTCT GGGTGAGCAA AAACAGGAAG GCAAAATGCC GCAAAAAAGG

8221 GAATAAGGGC GACACGGAAA TGTTGAATAC TCATACTCTT CCTTTTTCAA TATTATTGAA

8281 GCATTTATCA GGGTTATTGT CTCATGAGCG GATACATATT TGAATGTATT TAGAAAAATA

8341 AACAAATAGG GGTTCCGCGC ACATTTCCCC GAAAAGTGCC ACCTGACGTC GACGGATCGG

8401 GAGATCGATC TCCCGATCCC CTAGGGTCGA CTCTCAGTAC AATCTGCTCT GATGCCGCAT

8461 AGTTAAGCCA GTATCTGCTC CCTGCTTGTG TGTTGGAGGT CGCTGAGTAG TGCGCGAGCA

8521 AAATTTAAGC TACAACAAGG CAAGGCTTGA CCGACAATTG CATGAAGAAT CTGCTTAGGG

8581 TTAGGCGTTT TGCGCTGCTT CGCGATGTAC GGGCCAGATA TACGCGTTGA CATTGATTAT

8641 TGACTAGTTA TTAATAGTAA TCAATTACGG GGTCATTAGT TCATAGCCCA TATATGGAGT

8701 TCCGCGTTAC ATAACTTACG GTAAATGGCC CGCCTGGCTG ACCGCCCAAC GACCCCCGCC

8761 CATTGACGTC AATAATGACG TATGTTCCCA TAGTAACGCC AATAGGGACT TTCCATTGAC

8821 GTCAATGGGT GGAGTATTTA CGGTAAACTG CCCACTTGGC AGTACATCAA GTGTATC
```

In some embodiments, the cytidine base editor is BE4 having a nucleic acid sequence selected from one of the following:

```
Original BE4 nucleic acid sequence:
ATGagctcagagactggcccagtggctgtggaccccacattgagacg gcggatcgagccccatgagtttgaggtattcttcgatccgagagag ctccgcaaggagacctgcctgctttacgaaattaattggggggggc cggcactccatttggcgacatacatcacagaacactaacaagcac gtcgaagtcaacttcatcgagaagttcacgacagaaagatatttc tgtccgaacacaaggtgcagcattacctggtttctcagctggagc cgcgaatgtagtagggccatcactgaattcctgtcaaggtatccc cacatcactctgtttatttacatcgcaaggctgtaccaccacgct gacccccgcaatcgacaaggcctgcgggatttgatctcttcaggt gtgactatccaaattatgactgagcaggagtcaggatactgctgg agaaactttgtgaattatagcccgagtaatgaagcccactggcct aggtatccccatctgtgggtacgactgtacgttcttgaactgtac tgcatcatactgggcctgcctccttgtctcaacattctgagaagg aagcagccacagctgacattctttaccatcgctcttcagtcttgt cattaccagcgactgcccccacacattctctgggccaccgggttg aaatctggtggttcttctggtggttctagcggcagcgagactccc gggacctcagagtccgccacacccgaaagttctggtggttcttct ggtggttctgataaaaagtattctattggtttagccatcggcact aattccgttggatgggctgtcataaccgatgaatacaaagtacct tcaaagaaatttaaggtgttggggaacacagaccgtcattcgatt aaaaagaatcttatcggtgccctcctattcgatagtggcgaaacg gcagaggcgactcgcctgaaacgaaccgctcggagaaggtataca cgtcgcaagaaccgaatatgttacttacaagaaattttttagcaat gagatggccaaagttgacgattctttcttttcaccgtttggaagag tccttccttgtcgaagaggacaagaaacatgaacggcaccccatc tttggaaacatagtagatgaggtggcatatcatgaaaagtacccca acgatttatcacctcaaaaaaaagctagttgactcaactgataaa gcggacctgaggttaatctacttggctcttgcccatatgataaag ttccgtgggcactttctcattgagggtgatctaaatccggacaac tcggatgtcgacaaactgttcatccagttagtacaaacctataat cagttgtttgaagagaaccctataaatgcaagtggcgtggatgcg aaggctattcttagcgcccgcctctctaaatcccgacggctagaa aacctgatcgcacaattacccggagagaagaaaaatgggttgttc ggtaaccttatagcgctctcactaggcctgacaccaaattttaag tcgaacttcgacttagctgaagatgccaaattgcagcttagtaag gacacgtacgatgacgatctcgacaatctactggcacaaattgga gatcagtatgcggacttattttttggctgccaaaaaccttagcgat gcaatcctcctatctgacatactgagagttaatactgagattacc
```

-continued

```
aaggcgccgttatccgcttcaatgatcaaaaggtacgatgaacat caccaagacttgacacttctcaaggccctagtccgtcagcaactg cctgagaaatataaggaaatattctttgatcagtcgaaaaacggg tacgcaggttatattgacggcggagcgagtcaagaggaattctac aagtttatcaaacccatattagagaagatggatgggacggaagag ttgcttgtaaaactcaatcgcgaagatctactgcgaaagcagcgg actttcgacaacggtagcattccacatcaaatccacttaggcgaa ttgcatgctatacttagaaggcaggaggattttttatccgttcctc aaagacaatcgtgaaaagattgagaaaatcctaacctttcgcata ccttactatgtgggacccctggcccgagggaactctcggttcgca tggatgacaagaaagtccgaagaaacgattactccatggaatttt gaggaagttgtcgataaaggtgcgtcagctcaatcgttcatcgag aggatgaccaactttgacaagaatttaccgaacgaaaaagtattg cctaagcacagtttactttacgagtatttcacagtgtacaatgaa ctcacgaaagttaagtatgtcactgagggcatgcgtaaacccgcc tttctaagcggagaacagaagaaagcaatagtagatctgttattc aagaccaaccgcaaagtgacagttaagcaattgaaagaggactac tttaagaaaattgaatgcttcgattctgtcgagatctccggagta gaagatcgatttaatgcgtcacttggtacgtatcatgacctccta aagataattaaagataaggacttcctggataacgaagagaatgaa gatatcttagaagatatagtgttgactcttaccctctttgaagat cgggaaatgattgaggaaagactaaaaacatacgctcacctgttc gacgataaggttatgaaacagttaaagaggcgtcgctatacgggc tggggacgattgtcgcggaaacttatcaacgggataagagacaag caaagtggtaaaactattctcgatttttctaaagagcgacggcttc gccaataggaactttatgcagctgatccatgatgactctttaacc ttcaaagaggatatacaaaaggcacaggtttccggacaaggggac tcattgcacgaacatattgcgaatcttgctggttcgccagccatc aaaaagggcatactccagacagtcaaagtagtggatgagctagtt aaggtcatgggacgtcacaaaccggaaaacattgtaatcgagatg gcacgcgaaaatcaaacgactcagaaggggcaaaaaaacagtcga gagcggatgaagagaatagaagagggtattaaagaactgggcagc cagatcttaaaggagcatcctgtggaaaatacccaattgcagaac gagaaactttacctctattacctacaaaatggaagggacatgtat gttgatcaggaactggacataaaccgtttatctgattacgacgtc gatcacattgtaccccaatcctttttgaaggacgattcaatcgac aataaagtgcttacacgctcggataagaaccgagggaaaagtgac aatgttccaagcgaggaagtcgtaaagaaaatgaagaactattgg cggcagctcctaaatgcgaaactgataacgcaaagaaagttcgat aacttaactaaagctgagagggggtggcttgtctgaacttgacaag
```

-continued

```
gccggatttattaaacgtcagctcgtggaaacccgccaaatcaca aagcatgttgcacagatactagattcccgaatgaatacgaaatac gacgagaacgataagctgattcgggaagtcaaagtaatcacttta aagtcaaaattggtgtcggacttcagaaaggattttcaattctat aaagttagggagataaataactaccaccatgcgcacgacgcttat cttaatgccgtcgtagggaccgcactcattaagaaatacccgaag ctagaaagtgagtttgtgtatggtgattacaaagtttatgacgtc cgtaagataatcgcgaaaagcaaacaggagataggcaaggctaca gccaaatacttcttttattctaacattatgaatttctttaagacg gaaatcactctggcaaacggagagatacgcaaacgacctttaatt gaaaccaatggggagacaggtgaaatcgtatgggataagggccgg gacttcgcgacggtgagaaaagtttttgtccatgccccaagtcaac atagtaaagaaaactgaggtgcagaccggagggttttcaaaggaa tcgattcttccaaaaaggaatagtgataagctcatcgctcgtaaa aaggactgggacccgaaaaagtacggtggcttcgatagccctaca gttgcctattctgtcctagtagtggcaaaagttgagaagggaaaa tccaagaaactgaagtcagtcaaagaattattggggataacgatt atggagcgctcgtcttttgaaaagaaccccatcgacttccttgag gcgaaaggttacaaggaagtaaaaaaggatctcataattaaacta ccaaagtatagtctgtttgagttagaaaatggccgaaaacggatg ttggctagcgccggagagcttcaaaaggggaacgaactcgcacta ccgtctaaatacgtgaatttcctgtatttagcgtcccattacgag aagttgaaaggttcacctgaagataacgaacagaagcaacttttt gttgagcagcacaaacattatctcgacgaaatcatagagcaaatt tcggaattcagtaagagagtcatcctagctgatgccaatctggac aaagtattaagcgcatacaacaagcacagggataaacccatacgt gagcaggcggaaaatattatccatttgtttactcttaccaacctc ggcgctccagccgcattcaagtattttgacacaacgatagatcgc aaacgatacacttctaccaaggaggtgctagacgcgcacactgatt caccaatccatcacgggattatatgaaactcggatagatttgtca cagcttgggggtgactctggtggttctggaggatctggtggttct actaatctgtcagatattattgaaaaggagaccggtaagcaactg gttatccaggaatccatcctcatgctcccagaggaggtggaagaa gtcattgggaacaagccggaaagcgatatactcgtgcacaccgcc tacgacgagagcaccgacgagaatgtcatgcttctgactagcgac gcccctgaatacaagccttgggctctggtcatacaggatagcaac ggtgagaacaagattaagatgctctctggtggttctggaggatct gatggttctactaatctgtcagatattattgaaaaggagaccggt aagcaactggttatccaggaatccatcctcatgctcccagaggag gtggaagaagtcattgggaacaagccggaaagcgatatactcgtg cacaccgcctacgacgagagcaccgacgagaatgtcatgcttctg
```

-continued

```
actagcgacgcccctgaatacaagccttgggctctggtcatacag gatagcaacggtgagaacaagattaagatgctctctggtggttct

AAAAGGACGGCGGACGGATCAGAGTTCGAGAGTCCGAAAAAAAAA

CGAAAGGTCGAAtaa

BE4 Codon Optimization 1 nucleic acid sequence:
ATGTCATCCGAAACCGGGCCAGTGGCCGTAGACCCAACACTCAGG

AGGCGGATAGAACCCCATGAGTTTGAAGTGTTCTTCGACCCCAGA

GAGCTGCGCAAAGAGACTTGCCTCCTGTATGAAATAAATTGGGGG

GGTCGCCATTCAATTTGGAGGCACACTAGCCAGAATACTAACAAA

CACGTGGAGGTAAATTTTATCGAGAAGTTTACCACCGAAAGATAC

TTTTGCCCCAATACACGGTGTTCAATTACCTGGTTTCTGTCATGG

AGTCCATGTGGAGAATGTAGTAGAGCGATAACTGAGTTCCTGTCT

CGATATCCTCACGTCACGTTGTTTATATACATCGCTCGGCTTTAT

CACCATGCGGACCCGCGGAACAGGCAAGGTCTTCGGGACCTCATA

TCCTCTGGGGTGACCATCCAGATAATGACGGAGCAAGAGAGCGGA

TACTGCTGGCGAAACTTTGTTAACTACAGCCCAAGCAATGAGGCA

CACTGGCCTAGATATCCGCATCTCTGGGTTCGACTGTATGTCCTT

GAACTGTACTGCATAATTCTGGGACTTCCGCCATGCTTGAACATT

CTGCGGCGGAAACAACCACAGCTGACCTTTTTCACGATTGCTCTC

CAAAGTTGTCACTACCAGCGATTGCCACCCCACATCTTGTGGGCT

ACTGGACTCAAGTCTGGAGGAAGTTCAGGCGGAAGCAGCGGGTCT

GAAACGCCCGGAACCTCAGAGAGCGCAACGCCCGAAAGCTCTGGA

GGGTCAAGTGGTGGTAGTGATAAGAAATACTCCATCGGCCTCGCC

ATCGGTACGAATTCTGTCGGTTGGGCCGTTATCACCGATGAGTAC

AAGGTCCCTTCTAAGAAATTCAAGGTTTTGGGCAATACAGACCGC

CATTCTATAAAAAAAAAACCTGATCGGCGCCCTTTTGTTTGACAGT

GGTGAGACTGCTGAAGCGACTCGCCTGAAGCGAACTGCCAGGAGG

CGGTATACGAGGCGAAAAAACCGAATTTGTTACCTCCAGGAGATT

TTCTCAAATGAAATGGCCAAGGTAGATGATAGTTTTTTTCACCGC

TTGGAAGAAAGTTTTCTCGTTGAGGAGGACAAAAAGCACGAGAGG

CACCCAATCTTTGGCAACATAGTCGATGAGGTCGCATACCATGAG

AAATATCCTACGATCTATCATCTCCGCAAGAAGCTGGTCGATAGC

ACGGATAAAGCTGACCTCCGGCTGATCTACCTTGCTCTTGCTCAC

ATGATTAAATTCAGGGGCCATTTCCTGATAGAAGGAGACCTCAAT

CCCGACAATTCTGATGTCGACAAACTGTTTATTCAGCTCGTTCAG

ACCTATAATCAACTCTTTGAGGAGAACCCCATCAATGCTTCAGGG

GTGGACGCAAAGGCCATTTTGTCCGCGCGCTTGAGTAAATCACGA

CGCCTCGAGAATTTGATAGCTCAACTGCCGGGTGAGAAGAAAAAC

GGGGTTGTTTGGGAATCTCATAGCGTTGAGTTTGGGACTTACGCCA

AACTTTAAGTCTAACTTTGATTTGGCCGAAGATGCCAAATTGCAG

CTGTCCAAAGATACCTATGATGACGACTTGGATAACCTTCTTGCG
```

-continued

```
CAGATTGGTGACCAATACGCGGATCTGTTTCTTGCCGCAAAAAT

CTGTCCGACGCCATACTCTTGTCCGATATACTGCGCGTCAATACT

GAGATAACTAAGGCTCCCCTCAGCGCGTCCATGATTAAAAGATAC

GATGAGCACCACCAAGATCTCACTCTGTTGAAAGCCCTGGTTCGC

CAGCAGCTTCCAGAGAAGTATAAGGAGATATTTTTCGACCAATCT

AAAAACGGCTATGCGGGTTACATTGACGGTGGCGCCTCTCAAGAA

GAATTCTACAAGTTTATAAAGCCGATACTTGAGAAAATGGACGGT

ACAGAGGAATTGTTGGTTAAGCTCAATCGCGAGGACTTGTTGAGA

AAGCAGCGCACATTTGACAATGGTAGTATTCCACACCAGATTCAT

CTGGGCGAGTTGCATGCCATTCTTAGAAGACAAGAAGATTTTTAT

CCGTTTCTGAAAGATAACAGAGAAAAGATTGAAAAGATACTTACC

TTTCGCATACCGTATTATGTAGGTCCCCTGGCTAGAGGGAACAGT

CGCTTCGCTTGGATGACTCGAAAATCAGAAGAAACAATAACCCCC

TGGAATTTTGAAGAAGTGGTAGATAAAGGTGCGAGTGCCCAATCT

TTTATTGAGCGGATGACAAATTTTGACAAGAATCTGCCTAACGAA

AAGGTGCTTCCCAAGCATTCCCTTTTGTATGAATACTTTACAGTA

TATAATGAACTGACTAAAGTGAAGTACGTTACCGAGGGGATGCGA

AAGCCAGCTTTTCTCAGTGGCGAGCAGAAAAAAGCAATAGTTGAC

CTGCTGTTCAAGACGAATAGGAAGGTTACCGTCAAACAGCTCAAA

GAAGATTACTTTAAAAAGATCGAATGTTTTGATTCAGTTGAGATA

AGCGGAGTAGAGGATAGATTTAACGCAAGTCTTGGAACTTATCAT

GACCTTTTGAAGATCATCAAGGATAAAGATTTTTTGGACAACGAG

GAGAATGAAGATATCCTGGAAGATATAGTACTTACCTTGACGCTT

TTTGAAGATCGAGAGATGATCGAGGAGCGACTTAAGACGTACGCA

CATCTCTTTGACGATAAGGTTATGAAACAATTGAAACGCCGGCGG

TATACTGGCTGGGGCAGGCTTTCTCGAAAGCTGATTAATGGTATC

CGCGATAAGCAGTCTGGAAAGACAATCCTTGACTTTCTGAAAAGT

GATGGATTTGCAAATAGAAACTTTATGCAGCTTATACATGATGAC

TCTTTGACGTTCAAGGAAGACATCCAGAAGGCACAGGTATCCGGC

CAAGGGGATAGCCTCCATGAACACATAGCCAACCTGGCCGGCTCA

CCAGCTATTAAAAAGGGAATATTGCAAACCGTTAAGGTTGTTGAC

GAACTCGTTAAGGTTATGGGCCGACACAAACCAGAGAATATCGTG

ATTGAGATGGCTAGGGAGAATCAGACCACTCAAAAAGGTCAGAAA

AATTCTCGCGAAAGGATGAAGCGAATTGAAGAGGGAATCAAAGAA

CTTGGCTCTCAAATTTTGAAAGAGCACCCGGTAGAAAACACTCAG

CTGCAGAATGAAAAGCTGTATCTGTATTATCTGCAGAATGGTCGA

GATATGTACGTTGATCAGGAGCTGGATATCAATAGGCTCAGTGAC

TACGATGTCGACCACATCGTTCCTCAATCTTTCCTGAAAGATGAC

TCTATCGACAACAAAGTGTTGACGCGATCAGATAAGAACCGGGGA

AAATCCGACAATGTACCCTCAGAAGAAGTTGTCAAGAAGATGAAA
```

-continued

```
AACTATTGGAGACAATTGCTGAACGCCAAGCTCATAACACAACGC

AAGTTCGATAACTTGACGAAAGCCGAAAGAGGTGGGTTGTCAGAA

TTGGACAAAGCTGGCTTTATTAAGCGCCAATTGGTGGAGACCCGG

CAGATTACGAAACACGTAGCACAAATTTTGGATTCACGAATGAAT

ACCAAATACGACGAAAACGACAAATTGATACGCGAGGTGAAAGTG

ATTACGCTTAAGAGTAAGTTGGTTTCCGATTTCAGGAAGGATTTT

CAGTTTTACAAAGTAAGAGAAATAAACAACTACCACCACGCCCAT

GATGCTTACCTCAACGCGGTAGTTGGCACAGCTCTTATCAAAAAA

TATCCAAAGCTGGAAAGCGAGTTCGTTTACGGTGACTATAAAGTA

TACGACGTTCGGAAGATGATAGCCAAATCAGAGCAGGAAATTGGG

AAGGCAACCGCAAAATACTTCTTCTATTCAAACATCATGAACTTC

TTTAAGACGGAGATTACGCTCGCGAACGGCGAAATACGCAAGAGG

CCCCTCATAGAGACTAACGGCGAAACCGGGGAGATCGTATGGGAC

AAAGGACGGGACTTTGCGACCGTTAGAAAAGTACTTTCAATGCCA

CAAGTGAATATTGTTAAAAAGACAGAAGTACAAACAGGGGGGTTC

AGTAAGGAATCCATTTTGCCCAAGCGGAACAGTGATAAATTGATA

GCAAGGAAAAAGATTGGGACCCTAAGAAGTACGGTGGTTTCGAC

TCTCCTACCGTTGCATATTCAGTCCTTGTAGTTGCGAAAGTGGAA

AAGGGGAAAAGTAAGAAGCTTAAGAGTGTTAAAGAGCTTCTGGGC

ATAACCATAATGGAACGGTCTAGCTTCGAGAAAAATCCAATTGAC

TTTCTCGAGGCTAAAGGTTACAAGGAGGTAAAAAAGGACCTGATA

ATTAAACTCCCAAAGTACAGTCTCTTCGAGTTGGAGAATGGGAGG

AAGAGAATGTTGGCATCTGCAGGGGAGCTCCAAAAGGGGAACGAG

CTGGCTCTGCCTTCAAAATACGTGAACTTTCTGTACCTGGCCAGC

CACTACGAGAAACTCAAGGGGTTCTCCTGAGGATAACGAGCAGAAA

CAGCTGTTTGTAGAGCAGCACAAGCATTACCTGGACGAGATAATT

GAGCAAATTAGTGAGTTCTCAAAAAGAGTAATCCTTGCAGACGCG

AATCTGGATAAAGTTCTTTCCGCCTATAATAAGCACCGGGACAAG

CCTATACGAGAACAAGCCGAGAACATCATTCACCTCTTTACCCTT

ACTAATCTGGGCGCGCCGGCCGCCTTCAAATACTTCGACACCACG

ATAGACAGGAAAAGGTATACGAGTACCAAAGAAGTACTTGACGCC

ACTCTCATCCACCAGTCTATAACAGGGTTGTACGAAACGAGGATA

GATTTGTCCCAGCTCGGCGGCGACTCAGGAGGGTCAGGCGGCTCC

GGTGGATCAACGAATCTTTCCGACATAATCGAGAAAGAAACCGGC

AAACAGTTGGTGATCCAAGAATCAATCCTGATGCTGCCTGAAGAA

GTAGAAGAGGTGATTGGCAACAAACCTGAGTCTGACATTCTTGTC

CACACCGCGTATGACGAGAGCACGGACGAGAACGTTATGCTTCTC

ACTAGCGACGCCCCTGAGTATAAACCATGGGCGCTGGTCATCCAA

GATTCCAATGGGAAAACAAGATTAAGATGCTTAGTGGTGGGTCT

GGAGGGAGCGGTGGGTCCACGAACCTCAGCGACATTATTGAAAAA

GAGACTGGTAAACAACTTGTAATACAAGAGTCTATTCTGATGTTG
```

-continued

CCTGAAGAGGTGGAGGAGGTGATTGGGAACAAACCGGAGTCTGAT

ATACTTGTTCATACCGCCTATGACGAATCTACTGATGAGAATGTG

ATGCTTTTAACGTCAGACGCTCCCGAGTACAAACCCTGGGCTCTG

GTGATTCAGGACAGCAATGGTGAGAATAAGATTAAAATGTTGAGT

GGGGGCTCAAAGCGCACGGCTGACGGTAGCGAATTTGAGAGCCCC

AAAAAAAAACGAAAGGTCGAAtaa

BE4 Codon Optimization 2 nucleic acid sequence:
ATGAGCAGCGAGACAGGCCCTGTGGCTGTGGATCCTACACTGCGG

AGAAGAATCGAGCCCCACGAGTTCGAGGTGTTCTTCGACCCCAGA

GAGCTGCGGAAAGAGACATGCCTGCTGTACGAGATCAACTGGGGC

GGCAGACACTCTATCTGGCGGCACACAAGCCAGAACACCAACAAG

CACGTGGAAGTGAACTTTATCGAGAAGTTTACGACCGAGCGGTAC

TTCTGCCCCAACACCAGATGCAGCATCACCTGGTTTCTGAGCTGG

TCCCCTTGCGGCGAGTGCAGCAGAGCCATCACCGAGTTTCTGTCC

AGATATCCCCACGTGACCCTGTTCATCTATATCGCCCGGCTGTAC

CACCACGCCGATCCTAGAAATAGACAGGGACTGCGCGACCTGATC

AGCAGCGGAGTGACCATCCAGATCATGACCGAGCAAGAGAGCGGC

TACTGCTGGCGGAACTTCGTGAACTACAGCCCCAGCAACGAAGCC

CACTGGCCTAGATATCCTCACCTGTGGGTCCGACTGTACGTGCTG

GAACTGTACTGCATCATCCTGGGCCTGCCTCCATGCCTGAACATC

CTGAGAAGAAAGCAGCCTCAGCTGACCTTCTTCACAATCGCCCTG

CAGAGCTGCCACTACCAGAGACTGCCTCCACACATCCTGTGGGCC

ACCGGACTTAAGAGCGGAGGATCTAGCGGCGGCTCTAGCGGATCT

GAGACACCTGGCACAAGCGAGTCTGCCACACCTGAGAGTAGCGGC

GGATCTTCTGGCGGCTCCGACAAGAAGTACTCTATCGGACTGGCC

ATCGGCACCAACTCTGTTGGATGGGCCGTGATCACCGACGAGTAC

AAGGTGCCCAGCAAGAAATTCAAGGTGCTGGGCAACACCGACCGG

CACAGCATCAAGAAGAATCTGATCGGCGCCCTGCTGTTCGACTCT

GGCGAAACAGCCGAAGCCACCAGACTGAAGAGAACCGCCAGGCGG

AGATACACCCGGCGGAAGAACCGGATCTGCTACCTGCAAGAGATC

TTCAGCAACGAGATGGCCAAGGTGGACGACAGCTTCTTCCACAGA

CTGGAAGAGTCCTTCCTGGTGGAAGAGGACAAGAAGCACGAGCGG

CACCCCATCTTCGGCAACATCGTGGATGAGGTGGCCTACCACGAG

AAGTACCCCACCATCTACCACCTGAGAAAGAAACTGGTGGACAGC

ACCGACAAGGCCGACCTGAGACTGATCTACCTGGCTCTGGCCCAC

ATGATCAAGTTCCGGGGCCACTTTCTGATCGAGGGCGATCTGAAC

CCCGACAACAGCGACGTGGACAAGCTGTTCATCCAGCTGGTGCAG

ACCTACAACCAGCTGTTCGAGGAAAACCCCATCAACGCCTCTGGC

GTGGACGCCAAGGCTATCCTGTCTGCCAGACTGAGCAAGAGCAGA

AGGCTGGAAAACCTGATCGCCCAGCTGCCTGGCGAGAAGAAGAAT

GGCCTGTTCGGCAACCTGATTGCCCTGAGCCTGGGACTGACCCCT

-continued

AACTTCAAGAGCAACTTCGACCTGGCCGAGGATGCCAAACTGCAG

CTGAGCAAGGACACCTACGACGACGACGACCTGGACAATCTGCTGGCC

CAGATCGGCGATCAGTACGCCGACTTGTTTCTGGCCGCCAAGAAC

CTGTCCGACGCCATCCTGCTGAGCGATATCCTGAGAGTGAACACC

GAGATCACAAAGGCCCCTCTGAGCGCCTCTATGATCAAGAGATAC

GACGAGCACCACCAGGATCTGACCCTGCTGAAGGCCCTCGTTAGA

CAGCAGCTGCCAGAGAAGTACAAAGAGATTTTCTTCGATCAGTCC

AAGAACGGCTACGCCGGCTACATTGATGGCGGAGCCAGCCAAGAG

GAATTCTACAAGTTCATCAAGCCCATCCTGGAAAAGATGGACGGC

ACCGAGGAACTGCTGGTCAAGCTGAACAGAGAGGACCTGCTGCGG

AAGCAGCGGACCTTCGACAATGGCTCTATCCCTCACCAGATCCAC

CTGGGAGAGCTGCACGCCATTCTGCGCGGAGACAAGAGGACTTTTAC

CCATTCCTGAAGGACAACCGGGAAAAGATCGAGAAGATCCTGACC

TTCAGGATCCCCTACTACGTGGGACCACTGGCCAGAGGCAATAGC

AGATTCGCCTGGATGACCAGAAAGAGCGAGGAAACCATCACACCC

TGGAACTTCGAGGAAGTGGTGGACAAGGGCGCCAGCGCTCAGTCC

TTCATCGAGCGGATGACCAACTTCGATAAGAACCTGCCTAACGAG

AAGGTGCTGCCCAAGCACTCCCTGCTGTATGAGTACTTCACCGTG

TACAACGAGCTGACCAAAGTGAAATACGTGACCGAGGGAATGAGA

AAGCCCGCCTTTCTGAGCGGCGAGCAGAAAAAGGCCATTGTGGAT

CTGCTGTTCAAGACCAACCGGAAAGTGACCGTGAAGCAGCTGAAA

GAGGACTACTTCAAGAAAATCGAGTGCTTCGACAGCGTGGAAATC

AGCGGCGTGGAAGATCGGTTCAATGCCAGCCTGGGCACATACCAC

GACCTGCTGAAAATTATCAAGGACAAGGACTTCCTGGACAACGAA

GAGAACGAGGACATTCTCGAGGACATCGTGCTGACCCTGACACTG

TTTGAGGACAGAGAGATGATCGAGGAACGGCTGAAAACATACGCC

CACCTGTTCGACGACAAAGTGATGAAGCAACTGAAGCGGAGGCGG

TACACAGGCTGGGGCAGACTGTCTCGGAAGCTGATCAACGGCATC

CGGGATAAGCAGTCCGGCAAGACAATCCTGGATTTCCTGAAGTCC

GACGGCTTCGCCAACAGAAACTTCATGCAGCTGATCCACGACGAC

AGCCTGACCTTTAAAGAGGACATCCAGAAAGCCCAGGTGTCCGGC

CAAGGCGATTCTCTGCACGAGCACATTGCCAACCTGGCCGGATCT

CCCGCCATTAAGAAGGGCATCCTGCAGACAGTGAAGGTGGTGGAC

GAGCTTGTGAAAGTGATGGGCAGACACAAGCCCGAGAACATCGTG

ATCGAAATGGCCAGAGAGAACCAGACCACACAGAAGGGCCAGAAG

AACAGCCGCGAGAGAATGAAGCGGATCGAAGAGGGCATCAAAGAG

CTGGGCAGCCAGATCCTGAAAGAACACCCCGTGGAAAACACCCAG

CTGCAGAACGAGAAGCTGTACCTGTACTACCTGCAGAATGGACGG

GATATGTACGTGGACCAAGAGCTGGACATCAACCGGCTGAGCGAC

TACGATGTGGACCATATCGTGCCCCAGAGCTTTCTGAAGGACGAC

-continued

```
TCCATCGATAACAAGGTCCTGACCAGAAGCGACAAGAACCGGGGC

AAGAGCGATAACGTGCCCTCCGAAGAGGTGGTCAAGAAGATGAAG

AACTACTGGCGACAGCTGCTGAACGCCAAGCTGATTACCCAGCGG

AAGTTCGATAACCTGACCAAGGCCGAGAGAGGCGGCCTGAGCGAA

CTTGATAAGGCCGGCTTCATTAAGCGGCAGCTGGTGGAAACCCGG

CAGATCACCAAACACGTGGCACAGATTCTGGACTCCCGGATGAAC

ACTAAGTACGACGAGAATGACAAGCTGATCCGGGAAGTGAAAGTC

ATCACCCTGAAGTCTAAGCTGGTGTCCGATTTCCGGAAGGATTTC

CAGTTCTACAAAGTGCGGGAAATCAACAACTACCATCACGCCCAC

GACGCCTACCTGAATGCCGTTGTTGGAACAGCCCTGATCAAGAAG

TATCCCAAGCTGGAAAGCGAGTTCGTGTACGGCGACTACAAGGTG

TACGACGTGCGGAAGATGATCGCCAAGAGCGAACAAGAGATCGGC

AAGGCTACCGCCAAGTACTTTTTCTACAGCAACATCATGAACTTT

TTCAAGACAGAGATCACCCTGGCCAACGGCGAGATCCGGAAAAGA

CCCCTGATCGAGACAAACGGCGAAACCGGGGAGATCGTGTGGGAT

AAGGGCAGAGATTTTGCCACAGTGCGGAAAGTGCTGAGCATGCCC

CAAGTGAATATCGTGAAGAAAACCGAGGTGCAGACAGGCGGCTTC

AGCAAAGAGTCTATCCTGCCTAAGCGGAACAGCGATAAGCTGATC

GCCAGAAAGAAGGACTGGGACCCTAAGAAGTACGGCGGCTTCGAT

AGCCCTACCGTGGCCTATTCTGTGCTGGTGGTGGCCAAAGTGGAA

AAGGGCAAGTCCAAAAAGCTCAAGAGCGTGAAAGAGCTGCTGGGG

ATCACCATCATGGAAGAAGCAGCTTTGAGAAGAACCCGATCGAC

TTTCTGGAAGCCAAGGGCTACAAAGAAGTCAAGAAGGACCTCATC

ATCAAGCTCCCCAAGTACAGCCTGTTCGAGCTGGAAAATGGCCGG

AAGCGGATGCTGGCCTCAGCAGGCGAACTGCAGAAAGGCAATGAA

CTGGCCCTGCCTAGCAAATACGTCAACTTCCTGTACCTGGCCAGC

CACTATGAGAAGCTGAAGGGCAGCCCCGAGGACAATGAGCAAAAG

CAGCTGTTTGTGGAACAGCACAAGCACTACCTGGACGAGATCATC

GAGCAGATCAGCGAGTTCTCCAAGAGAGTGATCCTGGCCGACGCT

AACCTGGATAAGGTGCTGTCTGCCTATAACAAGCACCGGGACAAG

CCTATCAGAGAGCAGGCCGAGAATATCATCCACCTGTTTACCCTG

ACCAACCTGGGAGCCCCTGCCGCCTTCAAGTACTTCGACACCACC

ATCGACCGGAAGAGGTACACCAGCACCAAAGAGGTGCTGGACGCC

ACACTGATCCACCAGTCTATCACCGGCCTGTACGAAACCCGGATC

GACCTGTCTCAGCTCGGCGGCGATTCTGGTGGTTCTGGCGGAAGT

GGCGGATCCACCAATCTGAGCGACATCATCGAAAAAGAGACAGGC

AAGCAGCTCGTGATCCAAGAATCCATCCTGATGCTGCCTGAAGAG

GTTGAGGAAGTGATCGGCAACAAGCCTGAGTCCGACATCCTGGTG

CACACCGCCTACGATGAGAGCACCGATGAGAACGTCATGCTGCTG

ACAAGCGACGCCCCTGAGTACAAGCCTTGGGCTCTCGTGATTCAG

GACAGCAATGGGGAGAACAAGATCAAGATGCTGAGCGGAGGTAGC
```

-continued

```
GGAGGCAGTGGCGGAAGCACAAACCTGTCTGATATCATTGAAAAA

GAAACCGGGAAGCAACTGGTCATTCAAGAGTCCATTCTCATGCTC

CCGGAAGAAGTCGAGGAAGTCATTGGAAACAAACCCGAGAGCGAT

ATTCTGGTCCACACAGCCTATGACGAGTCTACAGACGAAAACGTG

ATGCTCCTGACCTCTGACGCTCCCGAGTATAAGCCCTGGGCACTT

GTTATCCAGGACTCTAACGGGGAAAACAAAATCAAAATGTTGTCC

GGCGGCAGCAAGCGGACAGCCGATGGATCTGAGTTCGAGAGCCCC

AAGAAGAAACGGAAGGTgGAGtaa
```

By "base editing activity" is meant acting to chemically alter a base within a polynucleotide. In one embodiment, a first base is converted to a second base. In one embodiment, the base editing activity is cytidine deaminase activity, e.g., converting target C·G to T·A. In another embodiment, the base editing activity is adenosine or adenine deaminase activity, e.g., converting A·T to G·C. In another embodiment, the base editing activity is cytidine deaminase activity, e.g., converting target C·G to T·A and adenosine or adenine deaminase activity, e.g., converting A·T to G·C.

In some embodiments, base editing activity is assessed by efficiency of editing. Base editing efficiency may be measured by any suitable means, for example, by sanger sequencing or next generation sequencing. In some embodiments, base editing efficiency is measured by percentage of total sequencing reads with nucleobase conversion effected by the base editor, for example, percentage of total sequencing reads with target A·T base pair converted to a G·C base pair or target C·G base pair to a T·A base pair. In some embodiments, base editing efficiency is measured by percentage of total cells with nucleobase conversion effected by the base editor, when base editing is performed in a population of cells.

The term "base editor system" refers to a system for editing a nucleobase of a target nucleotide sequence. In various embodiments, the base editor system comprises (1) a polynucleotide programmable nucleotide binding domain (e.g. Cas9); (2) a deaminase domain (e.g. an adenosine deaminase or a cytidine deaminase) for deaminating said nucleobase; and (3) one or more guide polynucleotide (e.g., guide RNA). In some embodiments, the polynucleotide programmable nucleotide binding domain is a polynucleotide programmable DNA binding domain. In some embodiments, the base editor is a cytidine base editor (CBE). In some embodiments, the base editor is an adenine or adenosine base editor (ABE). In some embodiments, the base editor system is an Adenosine Deaminase Base Editor 8 (ABE8).

In some embodiments, the ABE8 is a monomeric construct. In some embodiments, the ABE8 is ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, ABE8.24-m. In some embodiments, the ABE8 is a heteromeric construct. In some embodiments, the ABE8 is ABE8.1-d, ABE8.2-d, ABE8.3-d, ABE8.4-d, ABE8.5-d, ABE8.6-d, ABE8.7-d, ABE8.8-d, ABE8.9-d, ABE8.10-d, ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d.

In some embodiments, a base editor system may comprise more than one base editing component. For example, a base editor system may include more than one deaminase. In some embodiments, a base editor system may include one or more cytidine deaminases. In some embodiments, a base editor system may include one or more adenosine deaminases. In some embodiments, a single guide polynucleotide may be utilized to target different deaminases to a target nucleic acid sequence. In some embodiments, a single pair of guide polynucleotides may be utilized to target different deaminases to a target nucleic acid sequence.

The nucleobase components and the polynucleotide programmable nucleotide binding component of a base editor system may be associated with each other covalently or non-covalently, or any combination of associations and interactions thereof. For example, in some embodiments, a deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., a deaminase domain, can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., a deaminase domain, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a BER inhibitor. In some embodiments, the inhibitor of BER can be a uracil DNA glycosylase inhibitor (UGI). In some embodiments, the inhibitor of BER can be an inosine BER inhibitor. In some embodiments, the inhibitor of BER can be targeted to the target nucleotide sequence by the polynucleotide programmable nucleotide binding domain. In some embodiments, a polynucleotide programmable nucleotide binding domain can be fused or linked to an inhibitor of BER. In some embodiments, a polynucleotide programmable nucleotide binding domain can be fused or linked to a deaminase domain and an inhibitor of BER. In some embodiments, a polynucleotide programmable nucleotide binding domain can target an inhibitor of BER to a target nucleotide sequence by non-covalently interacting with or associating with the inhibitor of BER. For example, in some embodiments, the inhibitor of BER component can comprise an additional heterologous portion or domain that is capable of interacting with, associating with, or capable of forming a complex with an additional heterologous portion or domain that is part of a polynucleotide programmable nucleotide binding domain.

In some embodiments, the inhibitor of BER can be targeted to the target nucleotide sequence by the guide polynucleotide. For example, in some embodiments, the inhibitor of BER can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of BER. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker.

The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

By "beta-2 microglobulin (B2M) polypeptide" is meant a protein having at least about 85% amino acid sequence identity to UniProt Accession No. P61769 or a fragment thereof and having immunomodulatory activity. An exemplary B2M polypeptide sequence is provided below.

```
>spP61769B2MG HUMAN Beta-2-miCroglobulin
OS = Homo sapiens OX = 9606 GN = B2M
PE = 1 SV = 1
MSRSVALAVLALLSLSGLEAIQRTPKIQVYSRHPAENGKSN

FLNCYVSGFHPSDIEVDLLKNGERIEKVEHSDLSFSKDWS

FYLLYYTEFTPTEKDEYACRVNHVTLSQPKIVKWDRDM
```

By "beta-2-microglobulin (B2M) polynucleotide" is meant a nucleic acid molecule encoding a B2M polypeptide. The beta-2-microglobulin gene encodes a serum protein associated with the major histocompatibility complex. B2M is involved in non-self recognition by host CD8+ T cells. An exemplary B2M polynucleotide sequence is provided below.

```
>DQ217933.1 Homo sapiens beta-2-miCroglobin
(B2M) gene, Complete cds
CATGTCATAAATGGTAAGTCCAAGAAAAATACAGGTATTC

CCCCCCAAAGAAAACTGTAAAATCGACTTTTTTCTATCTG

TACTGTTTTTTATTGGTTTTTAAATTGGTTTTCCAAGTGA

GTAAATCAGAATCTATCTGTAATGGATTTTAAATTTAGTG

TTTCTCTGTGATGTAGTAAACAAGAAACTAGAGGCAAAAA

TAGCCCTGTCCCTTGCTAAACTTCTAAGGCACTTTTCTAG

TACAACTCAACACTAACATTTCAGGCCTTTAGTGCCTTAT

ATGAGTTTTTAAAAGGGGGAAAAGGGAGGGAGCAAGAGTG

TCTTAACTCATACATTTAGGCATAACAATTATTCTCATAT

TTTAGTTATTGAGAGGGCTGGTAGAAAAACTAGGTAAATA

ATATTAATAATTATAGCGCTTATTAAACACTACAGAACAC

TTACTATGTACCAGGCATTGTGGGAGGCTCTCTCTTGTGC

ATTATCTCATTTCATTAGGTCCATGGAGAGTATTGCATTT

TCTTAGTTTAGGCATGGCCTCCACAATAAAGATTATCAAA

AGCCTAAAAATATGTAAAAGAAACCTAGAAGTTATTTGTT

GTGCTCCTTGGGGAAGCTAGGCAAATCCTTTCAACTGAAA

ACCATGGTGACTTCCAAGATCTCTGCCCCTCCCCATCGCC

ATGGTCCACTTCCTCTTCTCACTGTTCCTCTTAGAAAAGA

TCTGTGGACTCCACCACCACGAAATGGCGGCACCTTATTT

ATGGTCACTTTAGAGGGTAGGTTTTCTTAATGGGTCTGCC

TGTCATGTTTAACGTCCTTGGCTGGGTCCAAGGCAGATGC

AGTCCAAACTCTCACTAAAATTGCCGAGCCCTTTGTCTTC
```

```
CAGTGTCTAAAATATTAATGTCAATGGAATCAGGCCAGAG

TTTGAATTCTAGTCTCTTAGCCTTTGTTTCCCCTGTCCAT

AAAATGAATGGGGGTAATTCTTTCCTCCTACAGTTTATTT

ATATATTCACTAATTCATTCATTCATCCATCCATTCGTTC

ATTCGGTTTACTGAGTACCTACTATGTGCCAGCCCCTGTT

CTAGGGTGGAAACTAAGAGAATGATGTACCTAGAGGGCGC

TGGAAGCTCTAAAGCCCTAGCAGTTACTGCTTTTACTATT

AGTGGTCGTTTTTTTCTCCCCCCGCCCCCCGACAAATCA

ACAGAACAAAGAAAATTACCTAAACAGCAAGGACATAGGG

AGGAACTTCTTGGCACAGAACTTTCCAAACACTTTTTCCT

GAAGGGATACAAGAAGCAAGAAAGGTACTCTTTCACTAGG

ACCTTCTCTGAGCTGTCCTCAGGATGCTTTTGGGACTATT

TTTCTTACCCAGAGAATGGAGAAACCCTGCAGGGAATTCC

CAAGCTGTAGTTATAAACAGAAGTTCTCCTTCTGCTAGGT

AGCATTCAAAGATCTTAATCTTCTGGGTTTCCGTTTTCTC

GAATGAAAAATGCAGGTCCGAGCAGTTAACTGGCTGGGGC

ACCATTAGCAAGTCACTTAGCATCTCTGGGGCCAGTCTGC

AAAGCGAGGGGGCAGCCTTAATGTGCCTCCAGCCTGAAGT

CCTAGAATGAGCGCCCGGTGTCCCAAGCTGGGGCGCGCAC

CCCAGATCGGAGGGCGCCGATGTACAGACAGCAAACTCAC

CCAGTCTAGTGCATGCCTTCTTAAACATCACGAGACTCTA

AGAAAAGGAAACTGAAAACGGGAAAGTCCCTCTCTCTAAC

CTGGCACTGCGTCGCTGGCTTGGAGACAGGTGACGGTCCC

TGCGGGCCTTGTCCTGATTGGCTGGGCACGCGTTTAATAT

AAGTGGAGGCGTCGCGCTGGCGGGCATTCCTGAAGCTGAC

AGCATTCGGGCCGAGATGTCTCGCTCCGTGGCCTTAGCTG

TGCTCGCGCTACTCTCTCTTTCTGGCCTGGAGGCTATCCA

GCGTGAGTCTCTCCTACCCTCCCGCTCTGGTCCTTCCTCT

CCCGCTCTGCACCCTCTGTGGCCCTCGCTGTGCTCTCTCG

CTCCGTGACTTCCCTTCTCCAAGTTCTCCTTGGTGGCCCG

CCGTGGGGCTAGTCCAGGGCTGGATCTCGGGGAAGCGGCG

GGGTGGCCTGGGAGTGGGGAAGGGGGTGCGCACCCGGGAC

GCGCGCTACTTGCCCCTTTCGGCGGGGAGCAGGGGAGACC

TTTGGCCTACGGCGACGGGAGGGTCGGGACAAAGTTTAGG

GCGTCGATAAGCGTCAGAGCGCCGAGGTTGGGGGAGGGTT

TCTCTTCCGCTCTTTCGCGGGGCCTCTGGCTCCCCCAGCG

CAGCTGGAGTGGGGGACGGGTAGGCTCGTCCCAAAGGCGC

GGCGCTGAGGTTTGTGAACGCGTGGAGGGGCGCTTGGGGT

CTGGGGGAGGCGTCGCCCGGGTAAGCCTGTCTGCTGCGGC

TCTGCTTCCCTTAGACTGGAGAGCTGTGGACTTCGTCTAG

GCGCCCGCTAAGTTCGCATGTCCTAGCACCTCTGGGTCTA
```

-continued

```
TGTGGGGCCACACCGTGGGGAGGAAACAGCACGCGACGTT

TGTAGAATGCTTGGCTGTGATACAAAGCGGTTTCGAATAA

TTAACTTATTTGTTCCCATCACATGTCACTTTTAAAAAAT

TATAAGAACTACCCGTTATTGACATCTTTCTGTGTGCCAA

GGACTTTATGTGCTTTGCGTCATTTAATTTTGAAAACAGT

TATCTTCCGCCATAGATAACTACTATGGTTATCTTCTGCC

TCTCACAGATGAAGAAACTAAGGCACCGAGATTTTAAGAA

ACTTAATTACACAGGGGATAAATGGCAGCAATCGAGATTG

AAGTCAAGCCTAACCAGGGCTTTTGCGGGAGCGCATGCCT

TTTGGCTGTAATTCGTGCATTTTTTTTTAAGAAAAACGCC

TGCCTTCTGCGTGAGATTCTCCAGAGCAAACTGGGCGGCA

TGGGCCCTGTGGTCTTTTCGTACAGAGGGCTTCCTCTTTG

GCTCTTTGCCTGGTTGTTTCCAAGATGTACTGTGCCTCTT

ACTTTCGGTTTTGAAAACATGAGGGGGTTGGGCGTGGTAG

CTTACGCCTGTAATCCCAGCACTTAGGGAGGCCGAGGCGG

GAGGATGGCTTGAGGTCCGTAGTTGAGACCAGCCTGGCCA

ACATGGTGAAGCCTGGTCTCTACAAAAAATAATAACAAAA

ATTAGCCGGGTGTGGTGGCTCGTGCCTGTGGTCCCAGCTG

CTCCGGTGGCTGAGGCGGGAGGATCTCTTGAGCTTAGGCT

TTTGAGCTATCATGGCGCCAGTGCACTCCAGCGTGGGCAA

CAGAGCGAGACCCTGTCTCTCAAAAAAGAAAAAAAAAAA

AAAGAAAGAGAAAGAAAGAAAGAAAGAAGTGAAGGTTT

GTCAGTCAGGGGAGCTGTAAAACCATTAATAAAGATAATC

CAAGATGGTTACCAAGACTGTTGAGGACGCCAGAGATCTT

GAGCACTTTCTAAGTACCTGGCAATACACTAAGCGCGCTC

ACCTTTTCCTCTGGCAAAACATGATCGAAAGCAGAATGTT

TTGATCATGAGAAAATTGCATTTAATTTGAATACAATTTA

TTTACAACATAAAGGATAATGTATATATCACCACCATTAC

TGGTATTTGCTGGTTATGTTAGATGTCATTTTAAAAAATA

ACAATCTGATATTTAAAAAAAAATCTTATTTTGAAAATTT

CCAAAGTAATACATGCCATGCATAGACCATTCTGGAAGA

TACCACAAGAAACATGTAATGATGATTGCCTCTGAAGGTC

TATTTTCCTCCTCTGACCTGTGTGTGGGTTTTGTTTTTGT

TTTACTGTGGGCATAAATTAATTTTTCAGTTAAGTTTTGG

AAGCTTAAATAACTCTCCAAAAGTCATAAAGCCAGTAACT

GGTTGAGCCCAAATTCAAACCCAGCCTGTCTGATACTTGT

CCTCTTCTTAGAAAAGATTACAGTGATGCTCTCACAAAAT

CTTGCCGCCTTCCCTCAAACAGAGAGTTCCAGGCAGGATG

AATCTGTGCTCTGATCCCTGAGGCATTTAATATGTTCTTA

TTATTAGAAGCTCAGATGCAAAGAGCTCTCTTAGCTTTTA
```

-continued

```
ATGTTATGAAAAAAATCAGGTCTTCATTAGATTCCCCAAT

CCACCTCTTGATGGGGCTAGTAGCCTTTCCTTAATGATAG

GGTGTTTCTAGAGAGATATATCTGGTCAAGGTGGCCTGGT

ACTCCTCCTTCTCCCCACAGCCTCCCAGACAAGGAGGAGT

AGCTGCCTTTTAGTGATCATGTACCCTGAATATAAGTGTA

TTTAAAAGAATTTTATACACATATATTTAGTGTCAATCTG

TATATTTAGTAGCACTAACACTTCTCTTCATTTTCAATGA

AAAATATAGAGTTTATAATATTTTCTTCCCACTTCCCCAT

GGATGGTCTAGTCATGCCTCTCATTTTGGAAAGTACTGTT

TCTGAAACATTAGGCAATATATTCCCAACCTGGCTAGTTT

ACAGCAATCACCTGTGGATGCTAATTAAAACGCAAATCCC

ACTGTCACATGCATTACTCCATTTGATCATAATGGAAAGT

ATGTTCTGTCCCATTTGCCATAGTCCTCACCTATCCCTGT

TGTATTTTATCGGGTCCAACTCAACCATTTAAGGTATTTG

CCAGCTCTTGTATGCATTTAGGTTTTGTTTCTTTGTTTTT

TAGCTCATGAAATTAGGTACAAAGTCAGAGAGGGGTCTGG

CATATAAAACCTCAGCAGAAATAAAGAGGTTTTGTTGTTT

GGTAAGAACATACCTTGGGTTGGTTGGGCACGGTGGCTCG

TGCCTGTAATCCCAACACTTTGGGAGGCCAAGGCAGGCTG

ATCACTTGAAGTTGGGAGTTCAAGACCAGCCTGGCCAACA

TGGTGAAATCCCGTCTCTACTGAAAATACAAAAATTAACC

AGGCATGGTGGTGTGTGCCTGTAGTCCCAGGAATCACTTG

AACCCAGGAGGCGGAGGTTGCAGTGAGCTGAGATCTCACC

ACTGCACACTGCACTCCAGCCTGGGCAATGGAATGAGATT

CCATCCCAAAAAATAAAAAAATAAAAAAATAAAGAACATA

CCTTGGGTTGATCCACTTAGGAACCTCAGATAATAACATC

TGCCACGTATAGAGCAATTGCTATGTCCCAGGCACTCTAC

TAGACACTTCATACAGTTTAGAAAATCAGATGGGTGTAGA

TCAAGGCAGGAGCAGGAACCAAAAAGAAAGGCATAAACAT

AAGAAAAAAAATGGAAGGGGTGGAAACAGAGTACAATAAC

ATGAGTAATTTGATGGGGCTATTATGAACTGAGAAATGA

ACTTTGAAAGTATCTTGGGGCCAAATCATGTAGACTCTT

GAGTGATGTGTTAAGGAATGCTATGAGTGCTGAGAGGGCA

TCAGAAGTCCTTGAGAGCCTCCAGAGAAAGGCTCTTAAAA

ATGCAGCGCAATCTCCAGTGACAGAAGATACTGCTAGAAA

TCTGCTAGAAAAAAAACAAAAAAGGCATGTATAGAGGAAT

TATGAGGGAAAGATACCAAGTCACGGTTTATTCTTCAAAA

TGGAGGTGGCTTGTTGGGAAGGTGGAAGCTCATTTGGCCA

GAGTGGAAATGGAATTGGGAGAAATCGATGACCAAATGTA

AACACTTGGTGCCTGATATAGCTTGACACCAAGTTAGCCC

CAAGTGAAATACCCTGGCAATATTAATGTGTCTTTTCCCG
```

-continued

ATATTCCTCAGGTACTCCAAAGATTCAGGTTTACTCACGT

CATCCAGCAGAGAATGGAAAGTCAAATTTCCTGAATTGCT

ATGTGTCTGGGTTTCATCCATCCGACATTGAAGTTGACTT

ACTGAAGAATGGAGAGAGAATTGAAAAAGTGGAGCATTCA

GACTTGTCTTTCAGCAAGGACTGGTCTTTCTATCTCTTGT

ACTACACTGAATTCACCCCCACTGAAAAAGAT

GAGTATGCCTGCCGTGTGAACCATGTGACTTTGTCACAGC

CCAAGATAGTTAAGTGGGGTAAGTCTTACATTCTTTTGTA

AGCTGCTGAAAGTTGTGTATGAGTAGTCATATCATAAAGC

TGCTTTGATATAAAAAAGGTCTATGGCCATACTACCCTGA

ATGAGTCCCATCCCATCTGATATAAACAATCTGCATATTG

GGATTGTCAGGGAATGTTCTTAAAGATCAGATTAGTGGCA

CCTGCTGAGATACTGATGCACAGCATGGTTTCTGAACCAG

TAGTTTCCCTGCAGTTGAGCAGGGAGCAGCAGCAGCACTT

GCACAAATACATATACACTCTTAACACTTCTTACCTACTG

GCTTCCTCTAGCTTTTGTGGCAGCTTCAGGTATATTTAGC

ACTGAACGAACATCTCAAGAAGGTATAGGCCTTTGTTTGT

AAGTCCTGCTGTCCTAGCATCCTATAATCCTGGACTTCTC

CAGTACTTTCTGGCTGGATTGGTATCTGAGGCTAGTAGGA

AGGGCTTGTTCCTGCTGGGTAGCTCTAAACAATGTATTCA

TGGGTAGGAACAGCAGCCTATTCTGCCAGCCTTATTTCTA

ACCATTTTAGACATTTGTTAGTACATGGTATTTTAAAAGT

AAAACTTAATGTCTTCCTTTTTTTTCTCCACTGTCTTTTT

CATAGATCGAGACATGTAAGCAGCATCATGGAGGTAAGTT

TTTGACCTTGAGAAAATGTTTTTGTTTCACTGTCCTGAGG

ACTATTTATAGACAGCTCTAACATGATAACCCTCACTATG

TGGAGAACATTGACAGAGTAACATTTTAGCAGGGAAAGAA

GAATCCTACAGGGTCATGTTCCCTTCTCCTGTGGAGTGGC

ATGAAGAAGGTGTATGGCCCCAGGTATGGCCATATTACTG

ACCCTCTACAGAGAGGGCAAAGGAACTGCCAGTATGGTAT

TGCAGGATAAAGGCAGGTGGTTACCCACATTACCTGCAAG

GCTTTGATCTTTCTTCTGCCATTTCCACATTGGACATCTC

TGCTGAGGAGAGAAAATGAACCACTCTTTTCCTTTGTATA

ATGTTGTTTTATTCTTCAGACAGAAGAGAGGAGTTATACA

GCTCTGCAGACATCCCATTCCTGTATGGGGACTGTGTTTG

CCTCTTAGAGGTTCCCAGGCCACTAGAGGAGATAAAGGGA

AACAGATTGTTATAACTTGATATAATGATACTATAATAGA

TGTAACTACAAGGAGCTCCAGAAGCAAGAGAGAGGGAGGA

ACTTGGACTTCTCTGCATCTTTAGTTGGAGTCCAAAGGCT

TTTCAATGAAATTCTACTGCCCAGGGTACATTGATGCTGA

-continued

AACCCCATTCAAATCTCCTGTTATATTCTAGAACAGGGAA

TTGATTTGGGAGAGCATCAGGAAGGTGGATGATCTGCCCA

GTCACACTGTTAGTAAATTGTAGAGCCAGGACCTGAACTC

TAATATAGTCATGTGTTACTTAATGACGGGGACATGTTCT

GAGAAATGCTTACACAAACCTAGGTGTTGTAGCCTACTAC

ACGCATAGGCTACATGGTATAGCCTATTGCTCCTAGACTA

CAAACCTGTACAGCCTGTTACTGTACTGAATACTGTGGGC

AGTTGTAACACAATGGTAAGTATTTGTGTATCTAAACATA

GAAGTTGCAGTAAAAATATGCTATTTTAATCTTATGAGAC

CACTGTCATATATACAGTCCATCATTGACCAAAACATCAT

ATCAGCATTTTTTCTTCTAAGATTTTGGGAGCACCAAAGG

GATACACTAACAGGATATACTCTTTATAATGGGTTTGGAG

AACTGTCTGCAGCTACTTCTTTTAAAAAGGTGATCTACAC

AGTAGAAATTAGACAAGTTTGGTAATGAGATCTGCAATCC

AAATAAAATAAATTCATTGCTAACCTTTTTCTTTTCTTTT

CAGGTTTGAAGATGCCGCATTTGGATTGGATGAATTCCAA

ATTCTGCTTGCTTGCTTTTTAATATTGATATGCTTATACA

CTTACACTTTATGCACAAAATGTAGGGTTATAATAATGTT

AACATGGACATGATCTTCTTTATAATTCTACTTTGAGTGC

TGTCTCCATGTTTGATGTATCTGAGCAGGTTGCTCCACAG

GTAGCTCTAGGAGGGCTGGCAACTTAGAGGTGGGGAGCAG

AGAATTCTCTTATCCAACATCAACATCTTGGTCAGATTTG

AACTCTTCAATCTCTTGCACTCAAAGCTTGTTAAGATAGT

TAAGCGTGCATAAGTTAACTTCCAATTTACATACTCTGCT

TAGAATTTGGGGGAAAATTTAGAAATATAATTGACAGGAT

TATTGGAAATTTGTTATAATGAATGAAACATTTTGTCATA

TAAGATTCATATTTACTTCTTATACATTTGATAAAGTAAG

GCATGGTTGTGGTTAATCTGGTTTATTTTTGTTCCACAAG

TTAAATAAATCATAAAACTTGATGTGTTATCTCTTATATC

TCACTCCCACTATTACCCCTTTATTTTCAAACAGGGAAAC

AGTCTTCAAGTTCCACTTGGTAAAAAATGTGAACCCCTTG

TATATAGAGTTTGGCTCACAGTGTAAAGGGCCTCAGTGAT

TCACATTTTCCAGATTAGGAATCTGATGCTCAAAGAAGTT

AAATGGCATAGTTGGGGTGACACAGCTGTCTAGTGGGAGG

CCAGCCTTCTATATTTTAGCCAGCGTTCTTTCCTGCGGGC

CAGGTCATGAGGAGTATGCAGACTCTAAGAGGGAGCAAAA

GTATCTGAAGGATTTAATATTTTAGCAAGGAATAGATATA

CAATCATCCCTTGGTCTCCCTGGGGGATTGGTTTCAGGAC

CCCTTCTTGGACACCAAATCTATGGATATTTAAGTCCCTT

CTATAAAATGGTATAGTATTTGCATATAACCTATCCACAT

CCTCCTGTATACTTTAAATCATTTCTAGATTACTTGTAAT

51

-continued

```
ACCTAATACAATGTAAATGCTATGCAAATAGTTGTTATTG

TTTAAGGAATAATGACAAGAAAAAAAAGTCTGTACATGCT

CAGTAAAGACACAACCATCCCTTTTTTTCCCCAGTGTTTT

TGATCCATGGTTTGCTGAATCCACAGATGTGGAGCCCCTG

GATACGGAAGGCCCGCTGTACTTTGAATGACAAATAACAG

ATTTAAA
```

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a Casn1 nuclease or a CRISPR ("clustered regularly interspaced short palindromic repeat")-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M., et al., Charpentier E. Science 337:816-821(2012), the entire contents of which is hereby incorporated by reference. Cas9 recognizes a short motif in the CRISPR repeat sequences (the PAM or proto-spacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., Proc. Natl. Acad. Sci. U.S.A. 98:4658-4663 (2001); "CRISPR RNA maturation by trans-encoded small RNA and host factor RNase III." Deltcheva E., et al., Nature 471:602-607(2011); and "A programmable dual-RNA-guided DNA endonuclease in adaptive bacterial immunity." Jinek M., et al. Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., Science. 337:816-821(2012); Qi et al., "Repurposing CRISPR as an RNA-Guided Platform for Sequence-Specific Control of Gene Expression" (2013) Cell. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., Science. 337:816-821(2012); Qi et al., Cell. 28; 152(5):1173-83 (2013)). In some embodiments, dCas9 corresponds to, or comprises in part or in whole, a Cas9 amino acid sequence having one or more mutations that inactivate the Cas9 nuclease activity. In some embodiments, a dCas9 domain comprises D10A and an H840A mutation or corresponding mutations in another Cas9. In some embodiments, a Cas9 nuclease has an inactive (e.g., an inactivated) DNA cleavage domain, that is, the Cas9 is a nickase, referred to as an "nCas9" protein (for "nickase" Cas9). It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided herein. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

53

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas9 refers to Cas9 from: *Coryne-bacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any other organism.

In some embodiments, the Cas9 is from *Neisseria men-ingitidis* (Nme). In some embodiments, the Cas9 is Nme1, Nme2 or Nme3. In some embodiments, the PAM-interacting domains for Nme1, Nme2 or Nme3 are N4GAT, N4CC, and N4CAAA, respectively (see e.g., Edraki, A., et al., A Compact, High-Accuracy Cas9 with a Dinucleotide PAM for In Vivo Genome Editing, Molecular Cell (2018)).

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all.

Exemplary amino acid sequences of suitable Cas9 domains and Cas9 fragments are provided herein, and additional suitable sequences of Cas9 domains and fragments will be apparent to those of skill in the art.

In some embodiments, Cas9 refers to a Cas9 from archaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napD-NAbp), and are within the scope of this disclosure.

In particular embodiments, napDNAbps useful in the methods of the invention include circular permutants, which are known in the art and described, for example, by Oakes et al., Cell 176, 254-267, 2019.

Non-limiting examples of a polynucleotide program-mable nucleotide binding domain which can be incorporated into a base editor include a CRISPR protein-derived domain, a restriction nuclease, a meganuclease, TAL nuclease (TALEN), and a zinc finger nuclease (ZFN).

In some embodiments, the nucleic acid programmable DNA binding protein (napDNAbp) or any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a natu-rally-occurring CasX or CasY protein. In some embodi-ments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

The term "Cas12b" or "Cas12b domain" refers to an RNA-guided nuclease comprising a Cas12b/C2c1 protein, or a fragment thereof (e.g., a protein comprising an active, inactive, or partially active DNA cleavage domain of Cas12b, and/or the gRNA binding domain of Cas12b). contents of each of which are incorporated herein by refer-ence). Cas12b orthologs have been described in various species, including, but not limited to, *Alicyclobacillus aci-doterrestris, Alicyclobacillus acidophilus* (Teng et al., Cell Discov. 2018 Nov. 27; 4:63), *Bacillus hisashi*, and *Bacillus* sp. V3-13. Additional suitable Cas12b nucleases and sequences will be apparent to those of skill in the art based on this disclosure.

In some embodiments, proteins comprising Cas12b or fragments thereof are referred to as "Cas12b variants." A Cas12b variant shares homology to Cas12b, or a fragment thereof. For example, a Cas12b variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas12b. In some embodiments, the Cas12b variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas12b. In some embodiments, the Cas12b variant com-prises a fragment of Cas12b (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas12b. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas12b. Exemplary Cas12b polypeptides are listed herein.

By "Cbl proto-oncogene B (CBLB) polypeptide" is meant a protein having at least about 85% amino acid sequence identity to GenBank Accession No. ABC86700.1 or a fragment thereof that is involved in the regulation of immune responses. An exemplary CBLB polypeptide sequence is provided below.

>ABC86700.1 CBL-B [Homo sapiens]
MANSMNGRNPGGRGGNPRKGRILGIIDAIQDAVGPPKQAAADRRTVEKTW

KLMDKVVRLCQNPKLQLKNSPPYILDILPDTYQHLRLILSKYDDNQKLAQ

LSENEYFKIYIDSLMKKSKRAIRLFKEGKERMYEEQSQDRRNLTKLSLIF

SHMLAEIKAIFPNGQFQGDNFRITKADAAEFWRKFFGDKTIVPWKVFRQC

LHEVHQISSGLEAMALKSTIDLTCNDYISVFEFDIFTRLFQPWGSILRNW

NFLAVTHPGYMAFLTYDEVKARLQKYSTKPGSYIFRLSCTRLGQWAIGYV

TGDGNILQTIPHNKPLFQALIDGSREGFYLYPDGRSYNPDLTGLCEPTPH

DHIKVTQEQYELYCEMGSTFQLCKICAENDKDVKIEPCGHLMCTSCLTAW

QESDGQGCPFCRCEIKGTEPIIVDPFDPRDEGSRCCSIIDPFGMPMLDLD

DDDDREESLMMNRLANVRKCTDRQNSPVTSPGSSPLAQRRKPQPDPLQIP

HLSLPPVPPRLDLIQKGIVRSPCGSPTGSPKSSPCMVRKQDKPLPAPPPP

LRDPPPPPPERPPPIPPDNRLSRHIHHVESVPSRDPPMPLEAWCPRDVFG

TNQLVGCRLLGEGSPKPGITASSNVNGRHSRVGSDPVLMRKHRRHDLPLE

GAKVFSNGHLGSEEYDVPPRLSPPPPVTTLLPSIKCTGPLANSLSEKTRD

PVEEDDDEYKIPSSHPVSLNSQPSHCHNVKPPVRSCDNGHCMLNGTHGPS

SEKKSNIPDLSIYLKGDVFDSASDPVPLPPARPPTRDNPKHGSSLNRTPS

DYDLLIPPLGEDAFDALPPSLPPPPPPARHSLIEHSEPPGSSSRPSSGQD

LFLLPSDPFVDLASGQVPLPPARRLPGENVKTNRTSQDYDQLPSCSDGSQ

APARPPKPRPRRTAPEIHHRKPHGPEAALENVDAKIAKLMGEGYAFEEVK

RALEIAQNNVEVARSILREFAFPPPVSPRLNL

By "Cbl proto-oncogene B (CBLB) polynucleotide" is meant a nucleic acid molecule encoding a CBLB polypeptide. The CBLB gene encodes an E3 ubiquitin ligase. An exemplary CBLB nucleic acid sequence is provided below.

>DQ349203.1 Homo sapiens CBL-B mRNA, complete cds
ATGGCAAACTCAATGAATGGCAGAAACCCTGGTGGTCGAGGAGGAAATCC

CCGAAAAGGTCGAATTTTGGGTATTATTGATGCTATTCAGGATGCAGTTG

GACCCCCTAAGCAAGCTGCCGCAGATCGCAGGACCGTGGAGAAGACTTGG

AAGCTCATGGACAAAGTGGTAAGACTGTGCCAAAATCCCAAACTTCAGTT

GAAAAATAGCCCACCATATATACTTGATATTTTGCCTGATACATATCAGC

ATTTACGACTTATATTGAGTAAATATGATGACAACCAGAAACTTGCCCAA

CTCAGTGAGAATGAGTACTTTAAAATCTACATTGATAGCCTTATGAAAAA

GTCAAAACGGGCAATAAGACTCTTTAAAGAAGGCAAGGAGAGAATGTATG

AAGAACAGTCACAGGACAGACGAAATCTCACAAAACTGTCCCTTATCTTC

AGTCACATGCTGGCAGAAATCAAAGCAATCTTTCCCAATGGTCAATTCCA

GGGAGATAACTTTCGTATCACAAAAGCAGATGCTGCTGAATTCTGGAGAA

AGTTTTTTGGAGACAAAACTATCGTACCATGGAAAGTATTCAGACAGTGC

-continued

CTTCATGAGGTCCACCAGATTAGCTCTGGCCTGGAAGCAATGGCTCTAAA

ATCAACAATTGATTTAACTTGCAATGATTACATTTCAGTTTTTGAATTTG

ATATTTTTACCAGGCTGTTTCAGCCTTGGGGCTCTATTTTGCGGAATTGG

AATTTCTTAGCTGTGACACATCCAGGTTACATGGCATTTCTCACATATGA

TGAAGTTAAAGCACGACTACAGAAATATAGCACCAAACCCGGAAGCTATA

TTTTCCGGTTAAGTTGCACTCGATTGGGACAGTGGGCCATTGGCTATGTG

ACTGGGGATGGGAATATCTTACAGACCATACCTCATAACAAGCCCTTATT

TCAAGCCCTGATTGATGGCAGCAGGGAAGGATTTTATCTTTATCCTGATG

GGAGGAGTTATAATCCTGATTTAACTGGATTATGTGAACCTACACCTCAT

GACCATATAAAAGTTACACAGGAACAATATGAATTATATTGTGAAATGGG

CTCCACTTTTCAGCTCTGTAAGATTTGTGCAGAGAATGACAAAGATGTCA

AGATTGAGCCTTGTGGGCATTTGATGTGCACCTCTTGCCTTACGGCATGG

CAGGAGTCGGATGGTCAGGGCTGCCCTTTCTGTCGTTGTGAAATAAAAGG

AACTGAGCCCATAATCGTGGACCCCTTTGATCCAAGAGATGAAGGCTCCA

GGTGTTGCAGCATCATTGACCCCTTTGGCATGCCGATGCTAGACTTGGAC

GACGATGATGATCGTGAGGAGTCCTTGATGATGAATCGGTTGGCAAACGT

CCGAAAGTGCACTGACAGGCAGAACTCACCAGTCACATCACCAGGATCCT

CTCCCCTTGCCCAGAGAAGAAAGCCACAGCCTGACCCACTCCAGATCCCA

CATCTAAGCCTGCCACCCGTGCCTCCTCGCCTGGATCTAATTCAGAAAGG

CATAGTTAGATCTCCCTGTGGCAGCCCAACGGGTTCACCAAAGTCTTCTC

CTTGCATGGTGAGAAAACAAGATAAACCACTCCCAGCACCACCTCCTCCC

TTAAGAGATCCTCCTCCACCGCCACCTGAAAGACCTCCACCAATCCCACC

AGACAATAGACTGAGTAGACACATCCATCATGTGGAAAGCGTGCCTTCCA

GAGACCCGCCAATGCCTCTTGAAGCATGGTGCCCTCGGGATGTGTTTGGG

ACTAATCAGCTTGTGGGATGTCGACTCCTAGGGGAGGGCTCTCCAAAACC

TGGAATCACAGCGAGTTCAAATGTCAATGGAAGGCACAGTAGAGTGGGCT

CTGACCCAGTGCTTATGCGGAAACACAGACGCCATGATTTGCCTTTAGAA

GGAGCTAAGGTCTTTTCCAATGGTCACCTTGGAAGTGAAGAATATGATGT

TCCTCCCCGGCTTTCTCCTCCTCCTCCTCCAGTTACCACCCTCCTCCCTAGCA

TAAAGTGTACTGGTCCGTTAGCAAATTCTCTTTCAGAGAAAACAAGAGAC

CCAGTAGAGGAAGATGATGATGAATACAAGATTCCTTCATCCCACCCTGT

TTCCCTGAATTCACAACCATCTCATTGTCATAATGTAAAACCTCCTGTTC

GGTCTTGTGATAATGGTCACTGTATGCTGAATGGAACACATGGTCCATCT

TCAGAGAAGAAATCAAACATCCCTGACTTAAGCATATATTTAAAGGGAGA

TGTTTTTGATTCAGCCTCTGATCCCGTGCCATTACCACCTGCCAGGCCTC

CAACTCGGGACAATCCAAAGCATGGTTCTTCACTCAACAGGACGCCCTCT

GATTATGATCTTCTCATCCCTCCATTAGGTGAAGATGCTTTTGATGCCCT

CCCTCCATCTCTCCCACCTCCCCCACCTCCTGCAAGGCATAGTCTCATTG

AACATTCAAAACCTCCTGGCTCCAGTAGCCGGCCATCCTCAGGACAGGAT

CTTTTTCTTCTTCCTTCAGATCCCTTTGTTGATCTAGCAAGTGGCCAAGT

-continued
```
TCCTTTGCCTCCTGCTAGAAGGTTACCAGGTGAAAATGTCAAAACTAACA

GAACATCACAGGACTATGATCAGCTTCCTTCATGTTCAGATGGTTCACAG

GCACCAGCCAGACCCCCTAAACCACGACCGCGCAGGACTGCACCAGAAAT

TCACCACAGAAAACCCCATGGGCCTGAGGCGGCATTGGAAAATGTCGATG

CAAAAATTGCAAAACTCATGGGAGAGGGTTATGCCTTTGAAGAGGTGAAG

AGAGCCTTAGAGATAGCCCAGAATAATGTCGAAGTTGCCCGGAGCATCCT

CCGAGAATTTGCCTTCCCTCCTCCAGTATCCCCACGTCTAAATCTATAG
```

By "chimeric antigen receptor" or "CAR" is meant a synthetic or engineered receptor comprising an extracellular antigen binding domain joined to one or more intracellular signaling domains (e.g., T cell signaling domain) that confers specificity for an antigen onto an immune effector cell. In some embodiments, the CAR includes a transmembrane domain.

By "chimeric antigen receptor T cell" or "CAR-T cell" is meant a T cell expressing a CAR that has antigen specificity determined by the antibody-derived targeting domain of the CAR. As used herein, "CAR-T cells" includes T cells or NK cells. As used herein, "CAR-T cells" includes cells engineered to express a CAR or a T cell receptor (TCR). In some embodiments, CAR-T cells can be T helper CD4+ and/or T effector CD8+ cells, optionally in defined proportions. Methods of making CARs (e.g., for treatment of cancer) are publicly available (see, e.g., Park et al., Trends Biotechnol., 29:550-557, 2011; Grupp et al., N Engl J Med., 368:1509-1518, 2013; Han et al., J. Hematol Oncol. 6:47, 2013; Haso et al., (2013) Blood, 121, 1165-1174; PCT Pubs. WO2012/079000, WO2013/059593; and U.S. Pub. 2012/0213783, each of which is incorporated by reference herein in its entirety).

By "class II, major histocornpatibility complex, transactivator (CIITA)" is meant a protein having at least about 85% amino acid sequence identity to NCBI Accession No. NP_001273331.1 or a fragment thereof and having immunomodulatory activity. An exemplary amino acid sequence is provided below.

```
>NP_001273331.1 MHC class II transactivator
isoform 1 [Homo sapiens]
MRCLAPRPAGSYLSEPQGSSQCATMELGPLEGGYLELLNSDADPLCLYHF

YDQMDLAGEEEIELYSEPDTDTINCDQFSRLLCDMEGDEETREAYANIAE

LDQYVFQDSQLEGLSKDIFIEHIGPDEVIGESMEMPAEVGQKSQKRPFPE

ELPADLKHWKPAEPPTVVTGSLLVGPVSDCSTLPCLPLPALFNQEPASGQ

MRLEKTDQIPMPFSSSSLSCLNLPEGPIQFVPTISTLPHGLWQISEAGTG

VSSIFIYHGEVPQASQVPPPSGFTVHGLPTSPDRPGSTSPFAPSATDLPS

MPEPALTSRANMTEHKTSPTQCPAAGEVSNKLPKWPEPVEQFYRSLQDTY

GAEPAGPDGILVEVDLVQARLERSSSKSLERELATPDWAERQLAQGGLAE

VLLAAKEHRRPRETRVIAVLGKAGOGKSYWAGAVSRAWACGRLPQYDFVF

SVPCHCLNRPGDAYGLQDLLFSLGPQPLVAADEVFSHILKRPDRVLLILD

GFEELEAQDGFLHSTCGPAPAEPCSLRGLLAGLFQKKLLRGCTLLLTARP

RGRLVQSLSKADALFELSGFSMEQAQAYVMRYFESSGMTEHQDRALTLLR

DRPLLLSHSHSPTLCRAVCQLSEALLELGEDAKLPSTLTGLYVGLLGRAA

LDSPPGALAELAKLAWELGRRHQSTLQEDQFPSADVRTWAMAKGLVQHPP

RAAESELAFPSFLLQCFLGALWLALSGEIKDKELPQYLALTPRKKRPYDN

WLEGVPRFLAGLIFQPPARCLGALLGPSAAASVDRKQKVLARYLKRLQPG

TLRARQLLELLHCAHEAEEAGIWQHVVQELPGRLSFLGTRLTPPDAHVLG

KALEAAGQDFSLDLRSTGICPSGLGSLVGLSCVTRFRAALSDTVALWESL

QQHGETKLLQAAEEKFTIEPFKAKSLKDVEDLGKLVQTQRTRSSSEDTAG

ELPAVRDLKKLEFALGPVSGPQAFPKLVRILTAFSSLQHLDLDALSENKI

GDEGVSQLSATFPQLKSLETLNLSQNNITDLGAYKLAEALPSLAASLLRL

SLYNNCICDVGAESLARVLPDMVSLRVMDVQYNKFTAAGAQQLAASLRRC

PHVETLAMWTPTIPFSVQEHLQQQDSRISLR
```

By "class II, major histocornpatibility complex, transactivator (CIITA)" is meant a nucleic acid encoding a CIITA polypeptide. An exemplary CIITA nucleic acid sequence is provided below.

```
>NM_001286402.1 Homo sapiens class II major histocompatibility complex transactivator
(CIITA), transcript variant 1, mRNA
GGTTAGTGATGAGGCTAGTGATGAGGCTGTGTGCTTCTGAGCTGGGCATCCGAAGGCATCCTTG

GGGAAGCTGAGGGCACGAGGAGGGGCTGCCAGACTCCGGGAGCTGCTGCCTGGCTGGGATTCCT

ACACAATGCGTTGCCTGGCTCCACGCCCTGCTGGGTCCTACCTGTCAGAGCCCCAAGGCAGCTC

ACAGTGTGCCACCATGGAGTTGGGGCCCCTAGAAGGTGGCTACCTGGAGCTTCTTAACAGCGAT

GCTGACCCCCTGTGCCTCTACCACTTCTATGACCAGATGGACCTGGCTGGAGAAGAAGAGATTG

AGCTCTACTCAGAACCCGACACAGACACCATCAACTGCGACCAGTTCAGCAGGCTGTTGTGTGA

CATGGAAGGTGATGAAGAGACCAGGGAGGCTTATGCCAATATCGCGGAACTGGACCAGTATGTC

TTCCAGGACTCCCAGCTGGAGGGCCTGAGCAAGGACATTTTCATAGAGCACATAGGACCAGATG

AAGTGATCGGTGAGAGTATGGAGATGCCAGCAGAAGTTGGGCAGAAAAGTCAGAAAAGACCCTT

CCCAGAGGAGCTTCCGGCAGACCTGAAGCACTGGAAGCCAGCTGAGCCCCCCACTGTGGTGACT

GGCAGTCTCCTAGTGGGACCAGTGAGCGACTGCTCCACCCTGCCCTGCCTGCCACTGCCTGCGC

TGTTCAACCAGGAGCCCAGCCTCCGGCCAGATGCGCCTGGAGAAAACCGACCAGATTCCCATGCC
```

```
TTTCTCCAGTTCCTCGTTGAGCTGCCTGAATCTCCCTGAGGGACCCATCCAGTTTGTCCCCACC

ATCTCCACTCTGCCCCATGGGCTCTGGCAAATCTCTGAGGCTGGAACAGGGGTCTCCAGTATAT

TCATCTACCATGGTGAGGTGCCCCAGGCCAGCCAAGTACCCCCTCCCAGTGGATTCACTGTCCA

CGGCCTCCCAACATCTCCAGACCGGCCAGGCTCCACCAGCCCCTTCGCTCCATCAGCCACTGAC

CTGCCCAGCATGCCTGAACCTGCCCTGACCTCCCGAGCAAACATGACAGAGCACAAGACGTCCC

CCACCCAATGCCCGGCAGCTGGAGAGGTCTCCAACAAGCTTCCAAAATGGCCTGAGCCGGTGGA

GCAGTTCTACCGCTCACTGCAGGACACGTATGGTGCCGAGCCCGCAGGCCCGGATGGCATCCTA

GTGGAGGTGGATCTGGTGCAGGCCAGGCTGGAGAGGAGCAGCAGCAAGAGCCTGGAGCGGGAAC

TGGCCACCCCGGACTGGGCAGAACGGCAGCTGGCCCAAGGAGGCCTGGCTGAGGTGCTGTTGGC

TGCCAAGGAGCACCGGCGGCCGCGTGAGACACGAGTGATTGCTGTGCTGGGCAAAGCTGGTCAG

GGCAAGAGCTATTGGGCTGGGGCAGTGAGCCGGGCCTGGGCTTGTGGCCGGCTTCCCCAGTACG

ACTTTGTCTTCTCTGTCCCCTGCCATTGCTTGAACCGTCCGGGGGATGCCTATGGCCTGCAGGA

TCTGCTCTTCTCCCTGGGCCCACAGCCACTCGTGGCGGCCGATGAGGTTTTCAGCCACATCTTG

AAGAGACCTGACCGCGTTCTGCTCATCCTAGACGGCTTCGAGGAGCTGGAAGCGCAAGATGGCT

TCCTGCACAGCACGTGCGGACCGGCACCGGCGGAGCCCTGCTCCCTCCGGGGGCTGCTGGCCGG

CCTTTTTCCAGAAGAAGCTGCTCCGAGGTTGCACCCTCCTCCTCACAGCCCGGCCCCGGGGCCGC

CTGGTCCAGAGCCTGAGCAAGGCCGACGCCCTATTTGAGCTGTCCGGCTTCTCCATGGAGCAGG

CCCAGGCATACGTGATGCGCTACTTTGAGAGCTCAGGGATGACAGAGCACCAAGACAGAGCCCT

GACGCTCCTCCGGGACCGGCCACTTCTTCTCAGTCACAGCCACAGCCCTACTTTGTGCCGGGCA

GTGTGCCAGCTCTCAGAGGCCCTGCTGGAGCTTGGGGAGGACGCCAAGCTGCCCTCCACGCTCA

CGGGACTCTATGTCGGCCTGCTGGGCCGTGCAGCCCTCGACAGCCCCCCCGGGGCCCTGGCAGA

GCTGGCCAAGCTGGCCTGGGAGCTGGGCCGCAGACATCAAAGTACCCTACAGGAGGACCAGTTC

CCATCCGCAGACGTGAGGACCTGGGCGATGGCCAAAGGCTTAGTCCAACACCCACCGCGGGCCG

CAGAGTCCGAGCTGGCCTTCCCCAGCTTCCTCCTGCAATGCTTCCTGGGGGCCCTGTGGCTGGC

TCTGAGTGGCGAAATCAAGGACAAGGAGCTCCCGCAGTACCTAGCATTGACCCCAAGGAAGAAG

AGGCCCTATGACAACTGGCTGGAGGGCGTGCCACGCTTTCTGGCTGGGCTGATCTTCCAGCCTC

CCGCCCGCTGCCTGGGAGCCCTACTCGGGGCCATCGGCGGCTGCCTCGGTGGACAGGAAGCAGAA

GGTGCTTGCGAGGTACCTGAAGCGGCTGCAGCCGGGGACACTGCGGGCGCGGCAGCTGCTGGAG

CTGCTGCACTGCGCCCACGAGGCCGAGGAGGCTGGAATTTGGCAGCACGTGGTACAGGAGCTCC

CCGGCCGCCTCTCTTTTCTGGGCACCCGCCTCACGCCTCCTGATGCACATGTACTGGGCAAGGC

CTTGGAGGCGGCGGGCCAAGACTTCTCCCTGGACCTCCGCAGCACTGGCATTTGCCCCTCTGGA

TTGGGGAGCCTCGTGGGACTCAGCTGTGTCACCCGTTTCAGGGCTGCCTTGAGCGACACGGTGG

CGCTGTGGGAGTCCCTGCAGCAGCATGGGGAGACCAAGCTACTTCAGGCAGCAGAGGAGAAGTT

CACCATCGAGCCTTTCAAAGCCAAGTCCCTGAAGGATGTGGAAGACCTGGGAAAGCTTGTGCAG

ACTCAGAGGACGAGAAGTTCCTCGGAAGACACAGCTGGGGAGCTCCCTGCTGTTCGGGACCTAA

AGAAACTGGAGTTTGCGCTGGGCCCTGTCTCAGGCCCCCAGGCTTTCCCCAAACTGGTGCGGAT

CCTCACGGCCTTTTCCTCCCTGCAGCATCTGGACCTGGATGCGCTGAGTGAGAACAAGATCGGG

GACGAGGGTGTCTCGCAGCTCTCAGCCACCTTCCCCCAGCTGAAGTCCTTGGAAACCCTCAATC

TGTCCCAGAACAACATCACTGACCTGGGTGCCTACAAACTCGCCGAGGCCCTGCCTTCGCTCGC

TGCATCCCTGCTCAGGCTAAGCTTGTACAATAACTGCATCTGCGACGTGGGAGCCGAGAGCTTG

GCTCGTGTGCTTCCGGACATGGTGTCCCTCCGGGTGATGGACGTCCAGTACAACAAGTTCACGG
```

-continued

CTGCCGGGGCCCAGCAGCTCGCTGCCAGCCTTCGGAGGTGTCCTCATGTGGAGACGCTGGCGAT

GTGGACGCCCACCATCCCATTCAGTGTCCAGGAACACCTGCAACAACAGGATTCACGGATCAGC

CTGAGATGATCCCAGCTGTGCTCTGGACAGGCATGTTCTCTGAGGACACTAACCACGCTGGACC

TTGAACTGGGTACTTGTGGACACAGCTCTTCTCCAGGCTGTATCCCATGAGCCTCAGCATCCTG

GCACCCGGCCCCTGCTGGTTCAGGGTTGGCCCCTGCCCGGCTGCGGAATGAACCACATCTTGCT

CTGCTGACAGACACAGGCCCGGCTCCAGGCTCCTTTAGCGCCCAGTTGGGTGGATGCCTGGTGG

CAGCTGCGGTCCACCCAGGAGCCCCGAGGCCTTCTCTGAAGGACATTGCGGACAGCCACGGCCA

GGCCAGAGGGAGTGACAGAGGCAGCCCCATTCTGCCTGCCCAGGCCCCTGCCACCCTGGGGAGA

AAGTACTTCTTTTTTTTTATTTTTAGACAGAGTCTCACTGTTGCCCAGGCTGGCGTGCAGTGGT

GCGATCTGGGTTCACTGCAACCTCCGCCTCTTGGGTTCAAGCGATTCTTCTGCTTCAGCCTCCC

GAGTAGCTGGGACTACAGGCACCCACCATCATGTCTGGCTAATTTTTCATTTTTAGTAGAGACA

GGGTTTTGCCATGTTGGCCAGGCTGGTCTCAAACTCTTGACCTCAGGTGATCCACCCACCTCAG

CCTCCCAAAGTGCTGGGATTACAAGCGTGAGCCACTGCACCGGGCCACAGAGAAAGTACTTCTC

CACCCTGCTCTCCGACCAGACACCTTGACAGGGCACACCGGGCACTCAGAAGACACTGATGGGC

AACCCCCAGCCTGCTAATTCCCCAGATTGCAACAGGCTGGGCTTCAGTGGCAGCTGCTTTTGTC

TATGGGACTCAATGCACTGACATTGTTGGCCAAAGCCAAAGCTAGGCCTGGCCAGATGCACCAG

CCCTTAGCAGGGAAACAGCTAATGGGACACTAATGGGGCGGTGAGAGGGGAACAGACTGGAAGC

ACAGCTTCATTTCCTGTGTCTTTTTTCACTACATTATAAATGTCTCTTTAATGTCACAGGCAGG

TCCAGGGTTTGAGTTCATACCCTGTTACCATTTTGGGGTACCCACTGCTCTGGTTATCTAATAT

GTAACAAGCCACCCCAAATCATAGTGGCTTAAAACAACACTCACATTTA

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

By "cytotoxic T-lymphocyte associated protein 4 (CTLA-4) polypeptide" is meant a protein having at least about 85% sequence identity to NCBI Accession No. EAW70354.1 or a fragment thereof. An exemplary amino acid sequence is provided below:

>EAW70354.1 cytotoxic T-lymphocyte-associated
protein 4 [Homo sapiens]
MACLGFQRHKAQLNLATRTWPCTLLFFLLFIPVFCKAMHVAQPAVVLASS

RGIASFVCEYASPGKATEVRVTVLRQADSQVTEVCAATYMMGNELTFLDD

SICTGTSSGNQVNLTIQGLRAMDTGLYICKVELMYPPPYYLGIGNGTQIY

VIDPEPCPDSDFLLWILAAVSSGLFFYSFLLTAVSLSKMLKKRSPLTTGV

YVKMPPTEPECEKQFQPYFIPIN

By "cytotoxic T-lymphocyte associated protein 4 (CTLA-4) polynucleotide" is meant a nucleic acid molecule encoding a CTLA-4 polypeptide. The CTLA-4 gene encodes an immunoglobulin superfamily and encodes a protein which transmits an inhibitory signal to T cells. An exemplary CTLA-4 nucleic acid sequence is provided below.

>BC074842.2 Homo sapiens cytotoxic T-lymphocyte-
associated protein 4, mRNA (cDNA clone MGC:
104099 IMAGE: 30915552), complete cds
GACCTGAACACCGCTCCCATAAAGCCATGGCTTGCCTTGGATTTCAGCGG

CACAAGGCTCAGCTGAACCTGGCTACCAGGACCTGGCCCTGCACTCTCCT

GTTTTTTCTTCTCTTCATCCCTGTCTTCTGCAAAGCAATGCACGTGGCCC

AGCCTGCTGTGGTACTGGCCAGCAGCCGAGGCATCGCCAGCTTTGTGTGT

GAGTATGCATCTCCAGGCAAAGCCACTGAGGTCCGGGTGACAGTGCTTCG

GCAGGCTGACAGCCAGGTGACTGAAGTCTGTGCGGCAACCTACATGATGG

GGAATGAGTTGACCTTCCTAGATGATTCCATCTGCACGGGCACCTCCAGT

GGAAATCAAGTGAACCTCACTATCCAAGGACTGAGGGCCATGGACACGGG

ACTCTACATCTGCAAGGTGGAGCTCATGTACCCACCGCCATACTACCTGG

GCATAGGCAACGGAACCCAGATTTATGTAATTGATCCAGAACCGTGCCCA

GATTCTGACTTCCTCCTCTGGATCCTTGCAGCAGTTAGTTCGGGGTTGTT

TTTTTATAGCTTTCTCCTCACAGCTGTTTCTTTGAGCAAAATGCTAAAGA

AAAGAAGCCCTCTTACAACAGGGGTCTATGTGAAAATGCCCCCAACAGAG

CCAGAATGTGAAAAGCAATTTCAGCCTTATTTTATTCCCATCAATTGAGA

AACCATTATGAAGAAGAGAGTCCATATTTCAATTTCCAAGAGCTGAGG

By "cluster of differentiation 2 (CD2) polypeptide" is meant a protein having at least about 85% amino acid sequence identity to NCBI Accession No. NP_001758.2 or fragment thereof and having immunomodulatory activity. An exemplary amino acid sequence is provided below.

>NP_001758.2 T-cell surface antigen CD2 isoform 2
precursor [Homo sapiens]
```
  1 MSFPCKFVAS FLLIFNVSSK GAVSKEITNA LETWGALGQD

INLDIPSFQM SDDIDDIKWE

61 KTSDKKKIAQ FRKEKETFKE KDTYKLFKNG TLKIKHLKTD

DQDIYKVSIY DTKGKNVLEK

121 IFDLKIQERV SKPKISWTCI NTTLTCEVMN GTDPELNLYQ

DGKHLKLSQR VITHKWTTSL

181 SAKFKCTAGN KVSKESSVEP VSCPEKGLDI YLIIGICGGG

SLLMVFVALL VFYITKRKKQ

241 RSRRNDEELE TRAHRVATEE RGRKPHQIPA STPQNPATSQ

HPPPPPGHRS QAPSHRPPPP

301 GHRVQHQPQK RPPAPSGTQV HQQKGPPLPR PRVQPKPPHG

AAENSLSPSS N
```

The CD2 cytoplasmic domain (amino acid residues 235-351) is shown in bold font. The architecture of an exemplary CD2 polypeptide from *Homo Sapiens* is shown in FIG. 4.

By "Cluster of Differentiation 2 (CD2) polynucleotide" is meant a nucleic acid encoding a CD2 polypeptide. An exemplary CD2 nucleic acid sequence is provided below. >

NM_001767.5 *Homo sapiens* CD2 molecule (CD2),
transcript variant 2, mRNA
```
  1 agtctcactt cagttccttt tgcatgaaga gctcagaatc aaaagaggaa accaacccct 61 aagatgagct ttccatgtaa atttgtagcc agcttccttc tgattttcaa tgtttcttcc 121 aaaggtgcag tctccaaaga gattacgaat gccttggaaa cctggggtgc cttgggtcag 181 gacatcaact tggacattcc tagttttcaa atgagtgatg atattgacga tataaaatgg 241 gaaaaaactt cagacaagaa aaagattgca caattcagaa aagagaaaga gactttcaag 301 gaaaaagata catataagct atttaaaaat ggaactctga aaattaagca tctgaagacc 361 gatgatcagg atatctacaa ggtatcaata tatgatacaa aaggaaaaaa tgtgttggaa 421 aaaatatttg atttgaagat tcaagagagg gtctcaaaac caaagatctc ctggacttgt 481 atcaacacaa ccctgacctg tgaggtaatg aatggaactg accccgaatt aaacctgtat 541 caagatggga aacatctaaa actttctcag agggtcatca cacacaagtg gaccaccagc 601 ctgagtgcaa aattcaagtg cacagcaggg aacaaagtca gcaaggaatc cagtgtcgag
```

```
 661 cctgtcagct gtccagagaa aggtctggac atctatctca tcattggcat atgtggagga 721 ggcagcctct tgatggtctt tgtggcactg ctcgttttct atatcaccaa aaggaaaaaa 781 cagaggagtc ggagaaatga tgaggagctg gagacaagag cccacagagt agctactgaa 841 gaaaggggcc ggaagcccca ccaaattcca gcttcaaccc ctcagaatcc agcaacttcc 901 caacatcctc ctccaccacc tggtcatcgt tcccaggcac ctagtcatcg tcccccgcct 961 cctggacacc gtgttcagca ccagcctcag aagaggcctc ctgctccgtc gggcacacaa 1021 gttcaccagc agaaaggccc gcccctcccc agacctcgag ttcagccaaa acctcccat 1081 ggggcagcag aaaactcatt gtccccttcc tctaattaaa aaagatagaa actgtctttt 1141 tcaataaaaa gcactgtgga tttctgccct cctgatgtgc atatccgtac ttccatgagg 1201 tgttttctgt gtgcagaaca ttgtcacctc ctgaggctgt gggccacagc cacctctgca 1261 tcttcgaact cagccatgtg gtcaacatct ggagtttttg gtctcctcag agagctccat 1321 cacaccagta aggagaagca atataagtgt gattgcaaga atggtagagg accgagcaca 1381 gaaatcttag agatttcttg tcccctctca ggtcatgtgt agatgcgata aatcaagtga 1441 ttggtgtgcc tgggtctcac tacaagcagc ctatctgctt aagagactct ggagtttctt 1501 atgtgccctg gtggacactt gcccaccatc ctgtgagtaa aagtgaaata aaagctttga 1561 ctaga
```

By "cluster of differentiation 5 (CD5) polypeptide" is meant a protein having at least about 85% amino acid sequence identity to NCBI Accession No. NP_001333385.1 or fragment thereof and having immunomodulatory activity. An exemplary amino acid sequence is provided below.

>NP_001333385.1 T-cell surface glycoprotein CD5
isoform 2 [Homo sapiens]
```
MVCSQSWGRSSKQWEDPSQASKVCQRLNCGVPLSLGPFLVTYTPQSSIIC

YGQLGSFSNCSHSRNDMCHSLGLTCLEPQKTTPPTTRPPPTTTPEPTAPP

RLQLVAQSGGQHCAGVVEFYSGSLGGTISYEAQDKTQDLENFLCNNLQCG

SFLKHLPETEAGRAQDPGEPREHQPLPIQWKIQNSSCTSLEHCFRKIKPQ
```

-continued

KSGRVLALLCSGFQPKVQSRLVGGSSICEGTVEVRQGAQWAALCDSSSAR

SSLRWEEVCREQQCGSVNSYRVLDAGDPTSRGLFCPHQKLSQCHELWERN

SYCKKVFVTCQDPNPAGLAAGTVASIILALVLLVVLLVVCGPLAYKKLVK

KFRQKKQRQWIGPTGMNQNMSFHRNHTATVRSHAENPTASHVDNEYSQPP

RNSHLSAYPALEGALHRSSMQPDNSSDSDYDLHGAQRL

By "cluster of differentiation 5 (CD5) polynucleotide" is meant a nucleic acid encoding a CD5 polypeptide. An exemplary CD5 nucleic acid sequence is provided below.

>NM_001346456.1 Homo sapiens CD5 molecule (CD5),
transcript variant 2, mRNA

```
   1  gagtcttgct gatgctcccg gctgaataaa cccccttcctt
      ctttaacttg gtgtctgagg 61  ggttttgtct gtggcttgtc ctgctacatt tcttggttcc
      ctgaccagga agcaaagtga 121  ttaacggaca gttgaggcag ccccttaggc agcttaggcc
      tgccttgtgg agcatccccg 181  cggggaactc tggccagctt gagcgacacg gatcctcaga
      gagctcccag gtaggcaatt 241  gcaccagtgg aatgcctcgt cagagcagtg catggcaggc
      ccctgtggag gatcaacgca 301  gtggctgaac acagggaagg aactggcact tggagtccgg
      acaactgaaa cttgtcgctt 361  cctgcctcgg acggctcagc tggtatgacc cagatttcca
      ggcaaggctc acccgttcca 421  actcgaagtg ccagggccag ctggaggtct acctcaagga
      cggatggcac atggtttgca 481  gccagagctg gggccggagc tccaagcagt gggaggaccc
      cagtcaagcg tcaaaagtct 541  gccagcggct gaactgtggg gtgcccttaa gccttggccc
      cttccttgtc acctacacac 601  ctcagagctc aatcatctgc tacggacaac tgggctcctt
      ctccaactgc agccacagca 661  gaaatgacat gtgtcactct ctgggcctga cctgcttaga
      accccagaag acaacacctc 721  caacgacaag gcccccgccc accacaactc cagagcccac
      agctcctccc aggctgcagc 781  tggtggcaca gtctggcggc cagcactgtg ccggcgtggt
      ggagttctac agcggcagcc 841  tggggggtac catcagctat gaggcccagg acaagaccca
      ggacctggag aacttcctct
```

-continued

```
 901  gcaacaacct ccagtgtggc tccttcttga agcatctgcc
      agagactgag gcaggcagag 961  cccaagaccc aggggagcca cgggaacacc agcccttgcc
      aatccaatgg aagatccaga 1021  actcaagctg tacctccctg gagcattgct tcaggaaaat
      caagccccag aaaagtggcc 1081  gagttcttgc cctcctttgc tcaggtttcc agcccaaggt
      gcagagccgt ctggtggggg 1141  gcagcagcat ctgtgaaggc accgtggagg tgcgccaggg
      ggctcagtgg gcagccctgt 1201  gtgacagctc ttcagccagg agctcgctgc ggtgggagga
      ggtgtgccgc gagcagcagt 1261  gtggcagcgt caactcctat cgagtgctgg acgctggtga
      cccaacatcc cggggggctct 1321  tctgtcccca tcagaagctg tcccagtgcc acgaactttg
      ggagagaaat tcctactgca 1381  agaaggtgtt tgtcacatgc caggatccaa accccgcagg
      cctggccgca ggcacggtgg 1441  caagcatcat cctggccctg gtgctcctgg tggtgctgct
      ggtcgtgtgc ggccccccttg 1501  cctacaagaa gctagtgaag aaattccgcc agaagaagca
      gcgccagtgg attggcccaa 1561  cgggaatgaa ccaaaacatg tctttccatc gcaaccacac
      ggcaaccgtc cgatcccatg 1621  ctgagaaccc cacagcctcc cacgtggata cgaatacag
      ccaacctccc aggaactccc 1681  acctgtcagc ttatccagct ctggaagggg ctctgcatcg
      ctcctccatg cagcctgaca 1741  actcctccga cagtgactat gatctgcatg gggctcagag
      gctgtaaaga actgggatcc 1801  atgagcaaaa agccgagagc cagacctgtt tgtcctgaga
      aaactgtccg ctcttcactt 1861  gaaatcatgt ccctatttct accccggcca gaacatggac
      agaggccaga agccttccgg 1921  acaggcgctg ctgccccgag tggcaggcca gctcacactc
      tgctgcacaa cagctcggcc 1981  gcccctccac ttgtggaagc tgtggtgggc agagccccaa
      aacaagcagc cttccaacta 2041  gagactcggg ggtgtctgaa gggggccccc tttccctgcc
      cgctggggag cggcgtctca
```

-continued

```
2101 gtgaaatcgg ctttctcctc agactctgtc cctggtaagg agtgacaagg aagctcacag 2161 ctgggcgagt gcattttgaa tagtttttg taagtagtgc ttttcctcct tcctgacaaa 2221 tcgagcgctt tggcctcttc tgtgcagcat ccacccctgc ggatccctct ggggaggaca 2281 ggaaggggac tcccggagac ctctgcagcc gtggtggtca gaggctgctc acctgagcac 2341 aaagacagct ctgcacattc accgcagctg ccagccaggg gtctgggtgg gcaccaccct 2401 gacccacagc gtcaccccac tccctctgtc ttatgactcc cctccccaac cccctcatct 2461 aaagacacct tcctttccac tggctgtcaa gcccacaggg caccagtgcc acccagggcc 2521 cggcacaaag gggcgcctag taaaccttaa ccaacttggt tttttgcttc acccagcaat 2581 taaaagtccc aagctgaggt agtttcagtc catcacagtt catcttctaa cccaagagtc 2641 agagatgggg ctggtcatgt tcctttggtt tgaataactc ccttgacgaa aacagactcc 2701 tctagtactt ggagatcttg gacgtacacc taatcccatg gggcctcagc ttccttaact 2761 gcaagtgaga agaggaggtc tacccaggag cctcgggtct gatcaaggga gaggccaggc 2821 gcagctcact gcggcggctc cctaagaagg tgaagcaaca tgggaacaca tcctaagaca 2881 ggtcctttct ccacgccatt tgatgctgta tctcctggga gcacaggcat caatggtcca 2941 agccgcataa taagtctgga agagcaaaag ggagttacta ggatatgggg tgggctgctc 3001 ccagaatctg ctcagctttc tgcccccacc aacaccctcc aaccaggcct tgccttctga 3061 gagcccccgt ggccaagccc aggtcacaga tcttcccccg accatgctgg gaatccagaa 3121 acagggaccc catttgtctt cccatatctg gtggaggtga gggggctcct caaaagggaa 3181 ctgagaggct gctcttaggg agggcaaagg ttcgggggca gccagtgtct cccatcagtg 3241 cctttttttaa taaaagctct ttcatctata gtttggccac catacagtgg cctcaaagca
```

-continued

```
3301 accatggcct acttaaaaac caaaccaaaa ataaagagtt tagttgagga gaaaaaaaaa 3361 aaaaaaaaaa aaaaaa
```

By "Cluster of Differentiation 7 (CD7) polypeptide" is meant a protein having at least about 85% amino acid sequence identity to NCBI Reference Sequence: NP_006128.1 or a fragment thereof and having immuno-modulatory activity. An exemplary amino acid sequence is provided below.

```
>NP_006128.1 T-cell antigen CD7 precursor [Homo
sapiens]
  1 MAGPPRLLLL PLLLALARGL PGALAAQEVQ QSPHCTTVPV

GASVNITCST SGGLRGIYLR

61 QLGPOPQDII YYEDGVVPTT DRRFRGRLDF SGSQDNLTIT

MHRLQLSDTG TYTCQAITEV

121 NVYGSGTLVL VTEEQSQGWH RCSDAPPRAS ALPAPPTGSA

LPDPQTASAL PDPPAASALP

181 AALAVISFLL GLGLGVACVL ARTQIKKLCS WRDKNSAACV

VYEDMSHSRC NTLSSPNQYQ
```

By "Cluster of Differentiation 7 (CD7) polynucleotide" is meant a nucleic acid molecule encoding a CD7 polypeptide. An exemplary CD7 nucleic acid sequence is provided below.

```
>NM_006137.7 Homo sapiens CD7 molecule (CD7), mRNA
  1 ctctctgagc tctgagcgcc tgcggtctcc tgtgtgctgc tctctgtggg gtcctgtaga 61 cccagagagg ctcagctgca ctcgcccggc tgggagagct gggtgtgggg aacatggccg 121 ggcctccgag gctcctgctg ctgcccctgc ttctggcgct ggctcgcggc ctgcctgggg 181 ccctggctgc ccaagaggtg cagcagtctc cccactgcac gactgtcccc gtgggagcct 241 ccgtcaacat cacctgctcc accagcgggg gcctgcgtgg gatctacctg aggcagctcg 301 ggccacagcc ccaagacatc atttactacg aggacggggt ggtgcccact acggacagac 361 ggttccgggg ccgcatcgac ttctcagggt cccaggacaa cctgactatc accatgcacc 421 gcctgcagct gtcggacact ggcacctaca cctgccaggc catcacggag gtcaatgtct 481 acggctccgg caccctggtc ctggtgacag aggaacagtc ccaaggatgg cacagatgct
```

-continued

```
541 cggacgcccc accaagggcc tctgccctcc ctgccccacc gacaggctcc gccatccctg 601 acccgcagac agcctctgcc ctccctgacc cgccagcagc ctctgccctc cctgcggccc 661 tggcggtgat ctccttcctc ctcgggctgg gcctgggggt ggcgtgtgtg ctggcgagga 721 cacagataaa gaaactgtgc tcgtggcggg ataagaattc ggcagcatgt gtggtgtacg 781 aggacatgtc gcacagccgc tgcaacacgc tgtcctcccc caaccagtac cagtgaccca 841 gtgggcccct gcacgtcccg cctgtggtcc ccccagcacc ttccctgccc caccatgccc 901 cccaccctgc cacacccctc accctgctgt cctcccacgg ctgcagcaga gtttgaaggg 961 cccagccgtg cccagctcca agcagacaca caggcagtgg ccaggcccca cggtgcttct 1021 cagtggacaa tgatgcctcc tccgggaagc cttccctgcc cagcccacgc cgccaccggg 1081 aggaagcctg actgtccttt ggctgcatct cccgaccatg gccaaggagg gcttttctgt 1141 gggatgggcc tgggcacgcg gccctctcct gtcagtgccg gcccacccac cagcaggccc 1201 ccaacccccca ggcagcccgg cagaggacgg gaggagacca gtcccccacc cagccgtacc 1261 agaaataaag gcttctgtgc ttcc
```

By "Cluster of Differentiation 33 (CD33) polypeptide" is meant a protein having at least about 85% amino acid sequence identity to NCBI Reference Sequence: NP_001763.3 or a fragment thereof. CD33 is also known as Siglec-3. An exemplary amino acid sequence is provided below.

```
> NP_001763.3 myeloid cell surface antigen CD33
isoform 1 precursor [Homo sapiens]
    1 MPLLLLLPLL WAGALAMDPN FWLQVQESVT VQEGLCVLVP

CTFFHPIPYY DKNSPVHGYW

61 FREGAIISRD SPVATNKLDQ EVQEETQGRF RLLGDPSRNN

CSLSIVDARR RDNGSYFFRM

121 ERGSTKYSYK SPQLSVHVTD LTHRPKILIP GTLEPGHSKN

LTCSVSWACE QGTPPIFSWL

181 SAAPTSLGPR TTHSSVLIIT PRPQDHGTNL TCQVKFAGAG

VTTERTIQLN VTVVPQNPTT
```

-continued

```
  241 GIFPGDGSGK QETRAGVVHG AIGGAGVTAL LALCLCLIFF

IVKTHRRKAA RTAVGRNDTH

301 PTTGSASPKH QKKSKLHGPT ETSSCSGAAP TVEMDEELHY

ASLNFHGMNP SKDTSTEYSE

361 VRTQ
```

By "Cluster of Differentiation 33 (CD33) polynucleotide" is meant a nucleic acid molecule encoding a CD33 polypeptide. An exemplary CD33 nucleic acid sequence is provided below.

```
> NM_001772.4 Homo sapiens CD33 molecule (CD33),
transcript variant 1, mRNA
    1 ctgctcacac aggaagccct ggaagctgct tcctcagaca tgccgctgct gctactgctg 61 cccctgctgt gggcaggggc cctggctatg gatccaaatt tctggctgca agtgcaggag 121 tcagtgacgg tacaggaggg tttgtgcgtc ctagtgccct gcactttctt ccatcccata 181 ccctactacg acaagaactc cccagttcat ggttactggt tccgggaagg agccattata 241 tccagggact ctccagtggc cacaaacaag ctagatcaag aagtacagga ggagactcag 301 ggcagattcc gcctccttgg ggatcccagt aggaacaact gctccctgag catcgtagac 361 gccaggagga gggataatgg ttcatacttc tttcggatgg agagaggaag taccaaatac 421 agttacaaat ctccccagct ctctgtgcat gtgacagact tgacccacag gcccaaaatc 481 ctcatccctg gcactctaga acccggccac tccaaaaacc tgacctgctc tgtgtcctgg 541 gcctgtgagc agggaacacc cccgatcttc tcctggttgt cagctgcccc cacctccctg 601 ggccccagga ctactcactc ctcggtgctc ataatcaccc cacggcccca ggaccacggc 661 accaacctga cctctcaggt gaagttcgct ggagctggtg tgactacgga gagaaccacc 721 cagctcaacg tcacctatgt tccacagaac ccaacaactg gtatctttcc aggagatggc 181 tcagggaaac aagagaccag agcaggagtg gttcatgggg ccattggagg agctggtgtt 841 acagccctgc tcgctctttg tctctgcctc atcttcttca tagtgaagac ccacaggagg
```

-continued

```
901  aaagcagcca ggacagcagt gggcaggaat gacacccacc ctaccacagg gtcagcctcc 961  ccgaaacacc agaagaagtc caagttacat ggccccactg aaacctcaag ctgttcaggt 1021 gccgcccta ctgtggagat ggatgaggag ctgcattatg cttccctcaa cttttcatggg 1081 atgaatcctt ccaaggacac ctccaccgaa tactcagagg tcaggaccca gtgaggaacc 1141 cacaagagca tcaggctcag ctagaagatc cacatcctct acaggtcggg gaccaaaggc 1201 tgattcttgg agatttaaca ccccacaggc aatgggttta tagacattat gtgagtttcc 1261 tgctatatta acatcatctt agactttgca agcagagagt cgtggaatca aatctgtgct 1321 ctttcatttg ctaagtgtat gatgtcacac aagctcctta accttccatg tctccatttt 1381 cttctctgtg aagtaggtat aagaagtcct atctcatagg gatgctgtga gcattaaata 1441 aaggtacaca tggaaaacac ca
```

By "Cluster of Differentiation 52 (CD52) polypeptide" is meant a protein having at least about 85% amino acid sequence identity to NCBI Reference Sequence: NP_001794.2 or a fragment thereof. CD52 is also known as CAMPATH-1. An exemplary amino acid sequence is provided below.

```
> NP_001794.2 CAMPATH-1 antigen precursor [Homo
sapiens}
   1   MKRFLFLLLT ISLLVMVQIQ TGLSGQNDTS QTSSPSASSN

ISGGIFLFFV ANAIIHLFCG

61   S
```

By "Cluster of Differentiation 52 (CD52) polynucleotide" is meant a nucleic acid molecule encoding a CD52 polypeptide. An exemplary CD52 nucleic acid sequence is provided below.

```
>NM_001803.3 Homo sapiens CD52 molecule (CD52),
mRNA
   1   agacagccct gagatcacct aaaaagctgc taccaagaca gccacgaaga tcctaccaaa 61   atgaagcgct tcctcttcct cctactcacc atcagcctcc tggttatggt acagatacaa 121   actggactct caggacaaaa cgacaccagc caaaccagca gcccctcagc atccagcaac 181   ataagcggag gcattttcct tttcttcgtg gccaatgcca taatccacct cttctgcttc
```

-continued

```
241  agttgaggtg acacgtctca gccttagccc tgtgcccct gaaacagctg ccaccatcac 301  tcgcaagaga atccctcca tctttgggag gggttgatgc cagacatcac caggttgtag 361  aagttgacag gcagtgccat gggggcaaca gccaaaatag gggggtaatg atgtaggggc 421  caagcagtgc ccagctgggg gtcaataaag ttacccttgt acttgca
```

By "Cluster of Differentiation 123 (CD123) polypeptide" is meant a protein having at least about 85% amino acid sequence identity to NCBI Reference Sequence: NP_002174.1 or a fragment thereof. CD123 is also known as the interleukin-3 receptor. An exemplary amino acid sequence is provided below.

```
>NP_002174.1 interleukin-3 receptor subunit alpha
isoform 1 precursor [Homo sapiens]
   1   MVLLWLTLLL IALPCLLQTK EDPNPPITNL RMKAKAQQLT

WDLNRNVTDI ECVKDADYSM

61   PAVNNSYCQF GAISLCEVTN YTVRVANPPF STWILFPENS

GKPWAGAENL TCWIHDVDFL

121   SCSWAVGPGA PADCQYDLYL NVANRRQQYE CLHYKTDAQG

TRIGCRFDDI SRLSSGSQSS

181   HILVRGRSAA FGIPCTDKFV VFSQIEILTP PNMTAKCNKT

HSFMHWKMRS HFNRKFRYEL

241   QIQKRMQPVI TEQVRDRTSF QLLNPGTYTV QIRARERVYE

FLSAWSTPQR FECDQEEGAN

301   TRAWRTSLLI ALGTLLALVC VFVICRRYLV MQRLFPRIPH

MKDPIGDSFQ NDKLVVWEAG

361   KAGLEECLVT EVQVVQKT
```

By "Cluster of Differentiation 123 (CD123) polynucleotide" is meant a nucleic acid molecule encoding a CD123 polypeptide. An exemplary CD123 nucleic acid sequence is provided below.

```
>NM_002183.4 Homo sapiens interleukin 3 receptor
subunit alpha (IL3RA), transcript variant 1, mRNA
   1   cttcggtttc tcttcgggga aagctgcttt cagcgcacac gggaagatat cagaaacatc 61   ctaggatcag gacaccccag atcttctcaa ctggaaccac gaaggctgtt tcttccacac 121   agtactttga tctccattta agcaggcacc tctgtcctgc gttccggagc tgcgttcccg 181   atggcctcc tttggctcac gctgctcctg atcgccctgc cctgtctcct gcaaacgaag
```

-continued

```
241 gaagatccaa acccaccaat cacgaaccta aggatgaaag caaaggctca gcagttgacc 301 tgggacctta acagaaatgt gaccgatatc gagtgtgtta aagacgccga ctattctatg 361 ccggcagtga acaatagcta ttgccagttt ggagcaattt ccttatgtga agtgaccaac 421 tacaccgtcc gagtggccaa cccaccattc tccacgtgga tcctcttccc tgagaacagt 481 gggaagcctt gggcaggtgc ggagaatctg acctgctgga ttcatgacgt ggatttcttg 541 agctgcagct gggcggtagg cccggggggcc cccgcggacg tccagtacga cctgtacttg 601 aacgttgcca acaggcgtca acagtacgag tgtcttcact acaaaacgga tgctcaggga 661 acacgtatcg ggtgtcgttt cgatgacatc tctcgactct ccagcggttc tcaaagttcc 721 cacatcctgg tgcgggggcag gagcgcagcc ttcggtatcc cctgcacaga taagtttgtc 781 gtcttttcac agattgagat attaactcca cccaacatga ctgcaaagtg taataagaca 841 cattccttta tgcactggaa aatgagaagt catttcaatc gcaaatttcg ctatgagctt 901 cagatacaaa agagaatgca gcctgtaatc acagaacagg tcagagacag aacctccttc 961 cagctactca atcctggaac gtacacagta caaataagag cccgggaaag agtgtatgaa 1021 ttcttgagcg cctggagcac ccccagcgc ttcgagtgcg accaggagga gggcgcaaac 1081 acacgtgcct ggcggacgtc gctgctgatc gcgctgggga cgccgctggc cctggtctgt
```

-continued

```
1141 gtcttcgtga tctgcagaag gtatctggtg atgcagagac tctttccccg catccctcac 1201 atgaaagacc ccatcggtga cagcttccaa aacgacaagc tggtggtctg ggaggcgggc 1261 aaagccggcc tggaggagtg tctggtgact gaagtacagg tcgtgcagaa aacttgagac 1321 tggggttcag ggcttgtggg ggtctgcctc aatctccctg gacgggccag gcgcctgcac 1381 agactggctg ctggacctgc gcacgcagcc caggaatgga cattcctaac gggtggtggg 1441 catgggagat gcctgtgtaa tttcgtccga agctgccagg aagaagaaca gaactttgtg 1501 tgtttatttc atgataaagt gatttttttt tttttaaccc a
```

By "Cluster of Differentiation 137 (CD137) polypeptide" is meant a protein having at least about 85% amino acid sequence identity to NCBI Reference Sequence: NP_001552.2 or a fragment thereof. CD137 is also known as 4-1BB. An exemplary amino acid sequence is provided below.

```
>NP_001552.2 Tumor necrosis factor receptor super-
family member 9 precursor [Homo sapiens]
   1 MGNSCYNIVA TLLLVLNFER TRSLQDPCSN CPAGTFCDNN

RNQICSPCPP NSFSSAGGQR

61 TCDICRQCKG VFRTRKECSS TSNAECDCTP GFHCLGAGCS

MCEQDCKQGQ ELTKKGCKDC

121 CFGTFNDQKR GICRPWTNCS LDGKSVLVNG TKERDVVCGP

SPADLSPGAS SVTPPAPARE

181 PGHSPQIISF FLALTSTALL FLLFFLTLRE SVVKRGRKKL

LYIFKQPFMR PVQTTQEEDG

241 CSCRFPEEEE GGCEL
```

By "Cluster of Differentiation 137 (CD137) polynucleotide" is meant a nucleic acid molecule encoding a CD137 polypeptide. An exemplary CD137 nucleic acid sequence is provided below.

```
>NM_001561.6 Homo sapiens TNF receptor superfamily member 9 (TNFRSF9), mRNA
   1 gcagaagcct gaagaccaag gagtggaaag ttctccggca gccctgagat ctcaagagtg 61 acatttgtga gaccagctaa tttgattaaa attctcttgg aatcagcttt gctagtatca 121 tacctgtgcc agatttcatc atgggaaaca gctgttacaa catagtagcc actctgttgc 181 tggtcctcaa ctttgagagg acaagatcat tgcaggatcc ttgtagtaac tgcccagctg 241 gtacattctg tgataataac aggaatcaga tttgcagtcc ctgtcctcca aatagtttct 301 ccagcgcagg tggacaaagg acctgtgaca tatgcaggca gtgtaaaggt gttttcagga 361 ccaggaagga gtgttcctcc accagcaatg cagagtgtga ctgcactcca gggtttcact 441 gcctgggggc aggatgcagc atgtgtgaac aggattgtaa acaaggtcaa gaactgacaa
```

```
 481 aaaaaggttg taaagactgt tgctttggga catttaacga tcagaaacgt ggcatctgtc 541 gaccctggac aaactgttct ttggatggaa agtctgtgct tgtgaatggg acgaaggaga 601 gggacgtggt ctgtggacca tctccagccg acctctctcc gggagcatcc tctgtgaccc 661 cgcctgcccc tgcgagagag ccaggacact ctccgcagat catctccttc tttcttgcgc 721 tgacgtcgac tgcgttgctc ttcctgctgt tcttcctcac gctccgtttc tctgttgtta 781 aacggggcag aaagaaactc ctgtatatat tcaaacaacc atttatgaga ccagtacaaa 841 ctactcaaga ggaagatggc tgtagctgcc gatttccaga agaagaagaa ggaggatgtg 901 aactgtgaaa tggaagtcaa tagggctgtt gggactttct tgaaaagaag caaggaaata 961 tgagtcatcc gctatcacag ctttcaaaag caagaacacc atcctacata atacccagga 1021 ttcccccaac acacgttctt ttctaaatgc caatgagttg gcctttaaaa atgcaccact 1081 ttttttttttt ttttgacagg gtctcactct gtcacccagg ctggagtgca gtggcaccac 1141 catggctctc tgcagccttg acctctggga gctcaagtga tcctcctgcc tcagtctcct 1201 gagtagctgg aactacaagg aagggccacc acacctgact aacttttttg tttttttgttt 1261 ggtaaagatg gcatttcacc atgttgtaca ggctggtctc aaactcctag gttcactttg 1321 gcctcccaaa gtgctgggat tacagacatg aactgccagg cccggccaaa ataatgcacc 1381 acttttaaca gaacagacag atgaggacag agctggtgat aaaaaaaaaa aaaaaaaagc 1441 attttctaga taccacttaa caggtttgag ctagtttttt tgaaatccaa agaaaattat 1501 agtttaaatt caattacata gtccagtggt ccaactataa ttataatcaa aatcaatgca 1561 ggtttgtttt ttggtgctaa tatgacatat gacaataagc cacgaggtgc agtaagtacc 1621 cgactaaagt ttccgtgggt tctgtcatgt aacacgacat gctccaccgt caggggggag 1681 tatgagcaga gtgcctgagt ttagggtcaa ggaeaaaaaa cctcaggcct ggaggaagtt 1741 ttggaaagag ttcaagtgtc tgtatatcct atggtcttct ccatcctcac accttctgcc 1801 tttgtcctgc tcccttttaa gccaggttac attctaaaaa ttcttaactt ttaacataat 1861 attttatacc aaagccaata aatgaactgc atatgatagg tatgaagtac agtgagaaaa 1921 ttaacacctg tgagctcatt gtcctaccac agcactagag tgggggccgc caaactccca 1981 tggccaaacc tggtgcacca tttgcctttg tttgtctgtt ggtttgcttg agacagtctt 2041 gctctgttgc ccaggctgga atggagtggc tattcacagg cacaatcata gcacacttta 2101 gccttaaact cctgggctca agtgatccac ccgcctcagt ctcccaagta gctgggatta 2161 caggtgcaaa cctggcatgc ctgccattgt ttggcttatg atctaaggat agctttttaa 2221 attttattca tttatttttt ttttgagaca gtgtctcact atgtctccca ggctggagta 2281 cagtggtaca atcttggatc accgcctccc agtttcaagt gatctccctg cctcagcctc 2341 ctaagtagct gggactacag gtatgtgcca ccacgcctgg ctaattttta tattttttagt 2401 agagacgggg tttcaccatg ttgtccaggc tggtctcaaa ctcctgacct caggtgatct 2461 gcccacctct gcctcccaaa gtgctgggat tacaggcatg agccaccatg cctggccatt 2521 tcttacactt ttgtatgaca tgcctattgc aagcttgcgt gcctctgtcc catgttattt 2581 tactctggga tttaggtgga gggagcagct tctatttgga acattggcca tcgcatggca 2641 aatgggtatc tgtcacttct gctcctattt agttggttct actataacct ttagagcaaa 2701 tcctgcagcc aagccaggca tcaatagggc agaaaagtat attctgtaaa taggggtgag 2761 gagaagatat ttctgaacaa tagtctactg cagtaccaaa ttgctttttca aagtggctgt 2821 tctaatgtac tcccgtcagt catataagtg tcatgtaagt atcccattga tccacatcct
```

-continued

```
2881 tgctaccctc tggtactatc aggtgccctt aattttgcca agccagtggg tatagaatga 2941 gatctcactg tggtcttagt ttgcatttgc ttggttactg atgagcacct tgtcaaatat 3001 ttatatacca tttgtgttta ttttttttaaa taaaatgctt gctcatgctt ttttgcccat 3061 ttgcaaaaaa acttggggcc gggtgcagtg gctcatgcct gtagtcccag ctctttggga 3121 ggccaaggtg ggcagatcgc ttgagcccag gagttcgaga ccagccttgg caacatggcg 3181 aaaccctgtc tttacaaaaa atacaaaaat tagccgggtg tggtggtgtg cacctgaagt 3241 cccagctact cagtaggttc gctttgagcc tgggaggcag aggttgcagt gagctgggac 3301 cgcatcacta cacttcagcc tgggcaacag agaaaaacct tttctcagaa acaaacaaac 3361 ccaaatgtgg ttgtttgtcc tgattcctaa aaggtcttta tgtattctag ataataatct 3421 ttggtcagtt atatgtgtta aaaaatatct tctttgtggc caggcacggt agctcacacc 3481 tgtaatccca gcactttgcg gggctgaggt gggtggatca tctgaggtca agagttcaag 3541 atcagcctgg ccaacacagt gaaaccccat ctctactaaa catgtacaaa acttagctgg 3601 gtatggtggc gggtgcctgt aaccccagct gctccagagg ctgtggcaga agaatcgctt 3661 gaacccagga ggcagaggtt gcagcgagcc aagattgtgc cattgcactc cagactgggt 3721 gacaagagtg aaattctgcc tatctatcta tctatctatc tatatctata tatatata 3781 tatatatcct ttgtaattta ttttttccctt tttaaaattt tttataaaat tctttttttat 3841 ttttattttt agcagaggtg aggttctga gatttcatta tgttgcccag gctggtcttg 3901 aactcctgag ctcaagtgat cctcccacct cagccttcca aagtgctgga attgcagaca 3961 tgagccaccg cgcccctcct gttttctct aattaatggt gtctttcttt gtctttctgg 4021 taataagcaa aaagttcttc atttgatttg gttaaattta taactgtttt ctcatatggt 4081 taacatttt tcttgcctgg ctaaagaaat ccttttctgc ccaatactat aaagaggttt 4141 gcccacattt tattccaaaa gttttaagtt ttgtctttca tcttgaagtc taatgtatca 4201 ggaactggct tttgtgcctg ttgggaggta gtgatccaat tccatgtctt gcatgtaggt 4261 aaccactggt ccctgcgcca tgtattcaat acgtcgtctt tctcctgcgg gtctgcaatc 4321 tcacctacca tccatcaagt ttccataggg ccatgggtct gcttctgggc tccctgttct 4381 gttccattgt caatttgtct atcctgtgcc actatcacac tgtgtttatt acaatagctt 4441 tgtaacagct ctcgatatcc ggtaggacat ctccctccac cttctttttc tacttcagaa 4501 gtgtcttagc taggtcaggc acggtggctc acgcctgtaa tcccagcact ttgggaggcc 4561 gacgcggatg gatcacctga ggtcaggagt tttgagacag cctggccaac atggtgaaac 4621 cccatctcta ctaaaaaata caaaaattag tcaggcatgg tggcatgtgc ctgtaatccc 4681 agctatttgg gaggctgagg ccggagaatt gcttgaaccc ggggggcgga ggttgcagtg 4741 agccgagatc gtaccattgc actccagcct gggtgacaga gcgaaactct gtctcaggaa 4801 aaaaagaaa agagatgtct tggttattct tggttctttta ttattcaata taaatttttag 4861 aagctgaatt tgaaaagatt tggattggaa tttcattaaa tctacaggtc aatttaggga 4921 gagttgataa ttttacagaa ttgagtcatc tggtgttcca ataagaataa gagaacaatt 4981 attggctgta caattcttgc caaatagtag gcaaagcaaa gcttaggaag tatactggtg 5041 ccatttcagg aacaaagcta ggtgcgaata tttttgtctt tctgaatcat gatgctgtaa 5101 gttctaaagt gatttctcct cttggctttg gacacatggt gtttaattac ctactgctga 5161 ctatccacaa acagaaagag actggtcatg ccccacaggg ttggggtatc caagataatg 5221 gagcgaggct ctcatgtgtc ctaggttaca caccgaaaat ccacagttta ttctgtgaag 5281 aaaggaggct atgtttatga tacagactgt gatattttta tcatagccta ttctggtatc
```

-continued

```
5341 atgtgcaaaa gctataaatg aaaaacacag gaacttggca tgtgagtcat tgctccccct 5401 aaatgacaat taataaggaa ggaacattga gacagaataa aatgatcccc ttctgggttt 5461 aatttagaaa gttccataat taggtttaat agaaataaat gtaaatttct atgattaaaa 5521 ataaattagc acatttaggg atacacaaat tataaatcat tttctaaatg ctaaaaacaa 5581 gctcaggttt ttttcagaag aaagttttaa tttttttttct ttagtggaag atatcactct 5641 gacggaaagt tttgatgtga ggggcggatg actataaagt gggcatcttc ccccacagga 5701 agatgtttcc atctgtgggt gagaggtgcc caccgcagct agggcaggtt acatgtgccc 5761 tgtgtgtggt aggacttgga gagtgatctt tatcaacgtt tttatttaaa agactatcta 5821 ataaaacaca aaactatgat gttcacagga aaaaagaat aagaaaaaaa ga
```

By "Cluster of Differentiation 247 (CD247) polypeptide" is meant a protein having at least about 85% amino acid sequence identity to NCBI Reference Sequence: NP_932170.1 or a fragment thereof. CD137 is also known as CD3(. An exemplary amino acid sequence is provided below.

```
>NP_932170.1 T-cell surface glycoprotein CD3 zeta
chain isoform 1 precursor [Homo sapiens]
   1 MKWKALFTAA ILQAQLPITE AQSFGLLDPK LCYLLDGILF

IYGVILTALF LRVKFSRSAD

61 APAYQQGQNQ LYNELNLGRR EEYDVLDKRR GRDPEMGGKP

QRRKNPQEGL YNELQKDKMA

121 EAYSEIGMKG ERRRGKGHDG LYQGLSTATK DTYDALHMQA

LPPR
```

By "Cluster of Differentiation 247 (CD247) polynucleotide" is meant a nucleic acid molecule encoding a CD247 polypeptide. An exemplary CD247 nucleic acid sequence is provided below.

```
>NM_NM_198053.3 Homo sapiens CD247 molecule
(CD247), transcript variant 1, mRNA
   1 aaccgtcccg gccaccgctg cctcagcctc tgcctcccag cctctttctg agggaaagga 61 caagatgaag tggaaggcgc tttttcaccgc ggccatcctg caggcacagt tgccgattac 121 agaggcacag agctttggcc tgctggatcc caaactctgc tacctgctgg atggaatcct 181 cttcatctat ggtgtcattc tcactgcctt gttcctgaga gtgaagttca gcaggagcgc 241 agacgccccc gagtaccagc agggccagaa ccagctctat aacgagctca atctaggacg 301 aagagaggag tacgatgttt tggacaagag acgtggccgg gaccctgaga tggggggaaa 361 gccgcagaga aggaagaacc ctcaggaagg cctgtacaat gaactgcaga agataagat
```

```
 421 ggcggaggcc tacagtgaga ttgggatgaa aggcgagcgc aggaggggca aggggcacga 481 tggcctttac caggtctca gtacagccac caaggacacc tacgacgccc ttcacatgca 541 ggccctgccc cctcgctaac agccagggga tttcaccact caaaggccag acctgcagac 601 gcccagatta tgagacacag gatgaagcat ttacaacccg gttcactctt ctcagccact 661 gaagtattcc cctttatgta caggatgctt tggttatatt tagctccaaa ccttcacaca 721 cagactgttg tccctgcact ctttaaggga gtgtactccc agggcttacg gccctggcct 781 tgggccctct ggtttgcogg tggtgcaggt agacctgtct cctggcggtt cctcgttctc 841 cctgggaggc gggcgcactg cctctcacag ctgagttgtt gagtctgttt tgtaaagtcc 901 ccagagaaag cgcagatgct agcacatgcc ctaatgtctg tatcactctg tgtctgagtg 961 gcttcactcc tgctgtaaat ttggcttctg ttgtcacctt cacctccttt caaggtaact 1021 gtactgggcc atgttgtgcc tccctggtga gagggccggg cagaggggca gatggaaagg 1081 agcctaggcc aggtgcaacc agggagctgc aggggcatgg gaaggtgggc gggcagggga 1141 gggtcagcca gggcctgcga gggcagcggg agcctccctg cctcaggcct ctgtgccgca 1201 ccattgaact gtaccatgtg ctacaggggc cagaagatga acagactgac cttgatgagc 1261 tgtgcacaaa gtggcataaa aaacatgtgg ttacacagtg tgaataaagt gctgcggagc
```

-continued

```
1321  aagaggaggc  cgttgattca  cttcacgctt  tcagcgaatg acaaaatcat  ctttgtgaag 1381  gcctcgcagg  aagacccaac  acatgggacc  tataactgcc cagcggacag  tggcaggaca 1441  ggaaaaaccc  gtcaatgtac  taggatactg  ctgcgtcatt acagggcaca  ggccatggat 1501  ggaaaacgct  ctctactctg  ctttttttct  actgttttaa tttatactgg  catgctaaag 1561  ccttcctatt  ttgcataata  aatgcttcag  tgaaaatgca
```

"Co-administration" or "co-administered" refers to administering two or more therapeutic agents or pharmaceutical compositions during a course of treatment. Such co-administration can be simultaneous administration or sequential administration. Sequential administration of a later-administered therapeutic agent or pharmaceutical composition can occur at any time during the course of treatment after administration of the first pharmaceutical composition or therapeutic agent.

The term "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz, G. E. and Schirmer, R. H., Principles of Protein Structure, Springer-Verlag, New York (1979)). According to such analyses, groups of amino acids can be defined where amino acids within a group exchange preferentially with each other, and therefore resemble each other most in their impact on the overall protein structure (Schulz, G. E. and Schirmer, R. H., supra). Non-limiting examples of conservative mutations include amino acid substitutions of amino acids, for example, lysine for arginine and vice versa such that a positive charge can be maintained; glutamic acid for aspartic acid and vice versa such that a negative charge can be maintained; serine for threonine such that a free —OH can be maintained; and glutamine for asparagine such that a free —NH$_2$ can be maintained.

The term "coding sequence" or "protein coding sequence" as used interchangeably herein refers to a segment of a polynucleotide that codes for a protein. The region or sequence is bounded nearer the 5' end by a start codon and nearer the 3' end with a stop codon. Coding sequences can also be referred to as open reading frames.

By "codon optimization" is meant a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/ (visited Jul. 9, 2002), and these tables can be adapted in a number of ways. See, Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

By "cytidine deaminase" is meant a polypeptide or fragment thereof capable of catalyzing a deamination reaction that converts an amino group to a carbonyl group. In one embodiment, the cytidine deaminase converts cytosine to uracil or 5-methylcytosine to thymine. PmCDA1, which is derived from Petromyzon marinus (Petromyzon marinus cytosine deaminase 1 ("PmCDA1")), or AID (Activation-induced cytidine deaminase ("AICDA")), which is derived from a mammal (e.g., human, swine, bovine, horse, monkey etc.), and APOBEC are exemplary cytidine deaminases.

The base sequence and amino acid sequence of PmCDA1 and the base sequence and amino acid sequence of human AID are shown below.

```
>tr|A5H718|A5H718_PETMA Cytosine deaminase OS = Petromyzon marinus OX = 7757 PE = 2
SV = 1
MTDAEYVRIHEKLDIYTFKKQFFNNKKSVSHRCYVLFELKRRGERRACFWGYAVNKPQSGTERG

IHAEIFSIRKVEEYLRDNPGQFTINWYSSWSPCADCAEKILEWYNQELRGNGHTLKIWACKLYY

EKNARNQIGLWNLRDNGVGLNVMVSEHYQCCRKIFIQSSHNQLNENRWLEKTLKRAEKRRSELS

IMIQVKILHTTKSPAV

>EF094822.1 Petromyzon marinus isolate PmCDA.21 cytosine deaminase mRNA, complete cds
TGACACGACACAGCCGTGTATATGAGGAAGGGTAGCTGGATGGGGGGGGGGGGAATACGTTCAG

AGAGGACATTAGCGAGCGTCTTGTTGGTGGCCTTGAGTCTAGACACCTGCAGACATGACCGACG

CTGAGTACGTGAGAATCCATGAGAAGTTGGACATCTACACGTTTAAGAAACAGTTTTTCAACAA

CAAAAAATCCGTGTCGCATAGATGCTACGTTCTCTTTGAATTAAAACGACGGGGTGAACGTAGA

GCGTGTTTTTGGGGCTATGCTGTGAATAAACCACAGAGCGGGACAGAACGTGGAATTCACGCCG
```

-continued

AAATCTTTAGCATTAGAAAAGTCGAAGAATACCTGCGCGACAACCCCGGACAATTCACGATAAA

TTGGTACTCATCCTGGAGTCCTTGTGCAGATTGCGCTGAAAAGATCTTAGAATGGTATAACCAG

GAGCTGCGGGGGAACGGCCACACTTTGAAAATCTGGGCTTGCAAACTCTATTACGAGAAAAATG

CGAGGAATCAAATTGGGCTGTGGAACCTCAGAGATAACGGGGTTGGGTTGAATGTAATGGTAAG

TGAACACTACCAATGTTGCAGGAAAATATTCATCCAATCGTCGCACAATCAATTGAATGAGAAT

AGATGGCTTGAGAAGACTTTGAAGCGAGCTGAAAAACGACGGAGCGAGTTGTCCATTATGATTC

AGGTAAAAATACTCCACACCACTAAGAGTCCTGCTGTTTAAGAGGCTATGCGGATGGTTTTC

>tr|Q6QJ80|Q6QJ80_HUMAN Activation-induced cytidine deaminase OS = *Homo sapiens*
OX = 9606 GN = AICDA PE = 2 SV = 1
MDSLLMNRRKFLYQFKNVRWAKGRRETYLCYVVKRRDSATSFSLDFGYLRNKNGCHVELLFLRY

ISDWDLDPGRCYRVTWFTSWSPCYDCARHVADFLRGNPNLSLRIFTARLYFCEDRKAEPEGLRR

LHRAGVQIAIMTFKAPV

>NG_011588.1: 5001-15681 *Homo sapiens* activation induced cytidine deaminase (AICDA),
RefSeqGene (LRG_17) on chromosome 12
AGAGAACCATCATTAATTGAAGTGAGATTTTTCTGGCCTGAGACTTGCAGGGAGGCAAGAAGAC

ACTCTGGACACCACTATGGACAGGTAAAGAGGCAGTCTTCTCGTGGGTGATTGCACTGGCCTTC

CTCTCAGAGCAAATCTGAGTAATGAGACTGGTAGCTATCCCTTTCTCTCATGTAACTGTCTGAC

TGATAAGATCAGCTTGATCAATATGCATATATATTTTTTGATCTGTCTCCTTTTCTTCTATTCA

GATCTTATACGCTGTCAGCCCAATTCTTTCTGTTTCAGACTTCTCTTGATTTCCCTCTTTTTCA

TGTGGCAAAAGAAGTAGTGCGTACAATGTACTGATTCGTCCTGAGATTTGTACCATGGTTGAAA

CTAATTTATGGTAATAATATTAACATAGCAAATCTTTAGAGACTCAAATCATGAAAAGGTAATA

GCAGTACTGTACTAAAAACGGTAGTGCTAATTTTCGTAATAATTTTGTAAATATTCAACAGTAA

AACAACTTGAAGACACACTTTCCTAGGGAGGCGTTACTGAAATAATTTAGCTATAGTAAGAAAA

TTTGTAATTTTAGAAATGCCAAGCATTCTAAATTAATTGCTTGAAAGTCACTATGATTGTGTCC

ATTATAAGGAGACAAATTCATTCAAGCAAGTTATTTAATGTTAAAGGCCCAATTGTTAGGCAGT

TAATGGCACTTTTACTATTAACTAATCTTTCCATTTGTTCAGACGTAGCTTAACTTACCTCTTA

GGTGTGAATTTGGTTAAGGTCCTCATAATGTCTTTATGTGCAGTTTTTGATAGGTTATTGTCAT

AGAACTTATTCTATTCCTACATTTATGATTACTATGGATGTATGAGAATAACACCTAATCCTTA

TACTTTACCTCAATTTAACTCCTTTATAAAGAACTTACATTACAGAATAAAGATTTTTTAAAAA

TATATTTTTTTGTAGAGACAGGGTCTTAGCCCAGCCGAGGCTGGTCTCTAAGTCCTGGCCCAAG

CGATCCTCCTGCCTGGGCCTCCTAAAGTGCTGGAATTATAGACATGAGCCATCACATCCAATAT

ACAGAATAAAGATTTTTAATGGAGGATTTAATGTTCTTCAGAAAATTTTCTTGAGGTCAGACAA

TGTCAAATGTCTCCTCAGTTTACACTGAGATTTTGAAAACAAGTCTGAGCTATAGGTCCTTGTG

AAGGGTCCATTGGAAATACTTGTTCAAAGTAAAATGGAAAGCAAAGGTAAAATCAGCAGTTGAA

ATTCAGAGAAAGACAGAAAAGGAGAAAAGATGAAATTCAACAGGACAGAAGGGAAATATATTAT

CATTAAGGAGGACAGTATCTGTAGAGCTCATTAGTGATGGCAAAATGACTTGGTCAGGATTATT

TTTAACCCGCTTGTTTCTGGTTTGCACGGCTGGGGATGCAGCTAGGGTTCTGCCTCAGGGAGCA

CAGCTGTCCAGAGCAGCTGTCAGCCTGCAAGCCTGAAACACTCCCTCGGTAAAGTCCTTCCTAC

TCAGGACAGAAATGACGAGAACAGGGAGCTGGAAACAGGCCCCTAACCAGAGAAGGGAAGTAAT

GGATCAACAAAGTTAACTAGCAGGTCAGGATCACGCAATTCATTTCACTCTGACTGGTAACATG

TGACAGAAACAGTGTAGGCTTATTGTATTTTCATGTAGAGTAGGACCCAAAAATCCACCCAAAG

TCCTTTATCTATGCCACATCCTTCTTATCTATACTTCCAGGACACTTTTTCTTCCTTATGATAA

-continued

```
GGCTCTCTCTCTCTCCACACACACACACACACACACACACACACACACACACACACACAAAC

ACACACCCCGCCAACCAAGGTGCATGTAAAAAGATGTAGATTCCTCTGCCTTTCTCATCTACAC

AGCCCAGGAGGGTAAGTTAATATAAGAGGGATTTATTGGTAAGAGATGATGCTTAATCTGTTTA

ACACTGGGCCTCAAAGAGAGAATTTCTTTTCTTCTGTACTTATTAAGCACCTATTATGTGTTGA

GCTTATATATACAAAGGGTTATTATATGCTAATATAGTAATAGTAATGGTGGTTGGTACTATGG

TAATTACCATAAAAATTATTATCCTTTTAAAATAAAGCTAATTATTATTGGATCTTTTTTAGTA

TTCATTTTATGTTTTTTATGTTTTTGATTTTTTAAAAGACAATCTCACCCTGTTACCCAGGCTG

GAGTGCAGTGGTGCAATCATAGCTTTCTGCAGTCTTGAACTCCTGGGCTCAAGCAATCCTCCTG

CCTTGGCCTCCCAAAGTGTTGGGATACAGTCATGAGCCACTGCATCTGGCCTAGGATCCATTTA

GATTAAAATATGCATTTTAAATTTTAAAATAATATGGCTAATTTTTACCTTATGTAATGTGTAT

ACTGGCAATAAATCTAGTTTGCTGCCTAAAGTTTAAAGTGCTTTCCAGTAAGCTTCATGTACGT

GAGGGGAGACATTTAAAGTGAAACAGACAGCCAGGTGTGGTGGCTCACGCCTGTAATCCCAGCA

CTCTGGGAGGCTGAGGTGGGTGGATCGCTTGAGCCCTGGAGTTCAAGACCAGCCTGAGCAACAT

GGCAAAACGCTGTTTCTATAACAAAAATTAGCCGGGCATGGTGGCATGTGCCTGTGGTCCCAGC

TACTAGGGGGCTGAGGCAGGAGAATCGTTGGAGCCCAGGAGGTCAAGGCTGCACTGAGCAGTGC

TTGCGCCACTGCACTCCAGCCTGGGTGACAGGACCAGACCTTGCCTCAAAAAAATAAGAAGAAA

AATTAAAAATAAATGGAAACAACTACAAAGAGCTGTTGTCCTAGATGAGCTACTTAGTTAGGCT

GATATTTTGGTATTTAACTTTTAAAGTCAGGGTCTGTCACCTGCACTACATTATTAAAATATCA

ATTCTCAATGTATATCCACACAAAGACTGGTACGTGAATGTTCATAGTACCTTTATTCACAAAA

CCCCAAAGTAGAGACTATCCAAATATCCATCAACAAGTGAACAAATAAACAAAATGTGCTATAT

CCATGCAATGGAATACCACCCTGCAGTACAAAGAAGCTACTTGGGGATGAATCCCAAAGTCATG

ACGCTAAATGAAAGAGTCAGACATGAAGGAGGAGATAATGTATGCCATACGAAATTCTAGAAAA

TGAAAGTAACTTATAGTTACAGAAAGCAAATCAGGGCAGGCATAGAGGCTCACACCTGTAATCC

CAGCACTTTGAGAGGCCACGTGGGAAGATTGCTAGAACTCAGGAGTTCAAGACCAGCCTGGGCA

ACACAGTGAAACTCCATTCTCCACAAAAATGGGAAAAAAAGAAAGCAAATCAGTGGTTGTCCTG

TGGGGAGGGGAAGGACTGCAAAGAGGGAAGAAGCTCTGGTGGGGTGAGGGTGGTGATTCAGGTT

CTGTATCCTGACTGTGGTAGCAGTTTGGGGTGTTTACATCCAAAAATATTCGTAGAATTATGCA

TCTTAAATGGGTGGAGTTTACTGTATGTAAATTATACCTCAATGTAAGAAAAAATAATGTGTAA

GAAAACTTTCAATTCTCTTGCCAGCAAACGTTATTCAAATTCCTGAGCCCTTTACTTCGCAAAT

TCTCTGCACTTCTGCCCCGTACCATTAGGTGACAGCACTAGCTCCACAAATTGGATAAATGCAT

TTCTGGAAAAGACTAGGGACAAAATCCAGGCATCACTTGTGCTTTCATATCAACCATGCTGTAC

AGCTTGTGTTGCTGTCTGCAGCTGCAATGGGGACTCTTGATTTCTTTAAGGAAACTTGGGTTAC

CAGAGTATTTCCACAAATGCTATTCAAATTAGTGCTTATGATATGCAAGACACTGTGCTAGGAG

CCAGAAAACAAAGAGGAGGAGAAATCAGTCATTATGTGGGAACAACATAGCAAGATATTTAGAT

CATTTTGACTAGTTAAAAAAGCAGCAGAGTACAAAATCACACATGCAATCAGTATAATCCAAAT

CATGTAAATATGTGCCTGTAGAAAGACTAGAGGAATAAACACAAGAATCTTAACAGTCATTGTC

ATTAGACACTAAGTCTAATTATTATTATTAGACACTATGATATTTGAGATTTAAAAAATCTTTA

ATATTTTAAAATTTAGAGCTCTTCTATTTTTCCATAGTATTCAAGTTTGACAATGATCAAGTAT

TACTCTTTCTTTTTTTTTTTTTTTTTTTTTTTTTGAGATGGAGTTTTGGCTTGTTGCCCATGC

TGGAGTGGAATGGCATGACCATAGCTCACTGCAACCTCCACCTCCTGGGTTCAAGCAAAGCTGT

CGCCTCAGCCTCCCGGGTAGATGGGATTACAGGCGCCCACCACCACACTCGGCTAATGTTTGTA
```

-continued

```
TTTTTAGTAGAGATGGGGTTTCACCATGTTGGCCAGGCTGGTCTCAAACTCCTGACCTCAGAGG

ATCCACCTGCCTCAGCCTCCCAAAGTGCTGGGATTACAGATGTAGGCCACTGCGCCCGGCCAAG

TATTGCTCTTATACATTAAAAAACAGGTGTGAGCCACTGCGCCCAGCCAGGTATTGCTCTTATA

CATTAAAAAAATAGGCCGGTGCAGTGGCTCACGCCTGTAATCCCAGCACTTTGGGAAGCCAAGGC

GGGCAGAACACCCGAGGTCAGGAGTCCAAGGCCAGCCTGGCCAAGATGGTGAAACCCCGTCTCT

ATTAAAAATACAAACATTACCTGGGCATGATGGTGGGCGCCTGTAATCCCAGCTACTCAGGAGG

CTGAGGCAGGAGGATCCGCGGAGCCTGGCAGATCTGCCTGAGCCTGGGAGGTTGAGGCTACAGT

AAGCCAAGATCATGCCAGTATACTTCAGCCTGGGCGACAAAGTGAGACCGTAACAAAAAAAAAA

AAATTTAAAAAAAGAAATTTAGATCAAGATCCAACTGTAAAAAGTGGCCTAAACACCACATTAA

AGAGTTTGGAGTTTATTCTGCAGGCAGAAGAGAACCATCAGGGGGTCTTCAGCATGGGAATGGC

ATGGTGCACCTGGTTTTTGTGAGATCATGGTGGTGACAGTGTGGGGAATGTTATTTTGGAGGGA

CTGGAGGCAGACAGACCGGTTAAAAGGCCAGCACAACAGATAAGGAGGAAGAAGATGAGGGCTT

GGACCGAAGCAGAGAAGAGCAAACAGGGAAGGTACAAATTCAAGAAATATTGGGGGGTTTGAAT

CAACACATTTAGATGATTAATTAAATATGAGGACTGAGGAATAAGAAATGAGTCAAGGATGGTT

CCAGGCTGCTAGGCTGCTTACCTGAGGTGGCAAAGTCGGGAGGAGTGGCAGTTTAGGACAGGGG

GCAGTTGAGGAATATTGTTTTGATCATTTTGAGTTTGAGGTACAAGTTGGACACTTAGGTAAAG

ACTGGAGGGGAAATCTGAATATACAATTATGGGACTGAGGAACAAGTTTATTTTATTTTTTGTT

TCGTTTTCTTGTTGAAGAACAAATTTAATTGTAATCCCAAGTCATCAGCATCTAGAAGACAGTG

GCAGGAGGTGACTGTCTTGTGGGTAAGGGTTTGGGGTCCTTGATGAGTATCTCTCAATTGGCCT

TAAATATAAGCAGGAAAAGGAGTTTATGATGGATTCCAGGCTCAGCAGGGCTCAGGAGGGCTCA

GGCAGCCAGCAGAGGAAGTCAGAGCATCTTCTTTGGTTTAGCCCAAGTAATGACTTCCTTAAAA

AGCTGAAGGAAAATCCAGAGTGACCAGATTATAAACTGTACTCTTGCATTTTCTCTCCCTCCTC

TCACCCACAGCCTCTTGATGAACCGGAGGAAGTTTCTTTACCAATTCAAAAATGTCCGCTGGGC

TAAGGGTCGGCGTGAGACCTACCTGTGCTACGTAGTGAAGAGGCGTGACAGTGCTACATCCTTT

TCACTGGACTTTGGTTATCTTCGCAATAAGGTATCAATTAAAGTCGGCTTTGCAAGCAGTTTAA

TGGTCAACTGTGAGTGCTTTTAGAGCCACCTGCTGATGGTATTACTTCCATCCTTTTTTGGCAT

TTGTGTCTCTATCACATTCCTCAAATCCTTTTTTTTATTTCTTTTTCCATGTCCATGCACCCAT

ATTAGACATGGCCCAAAATATGTGATTTAATTCCTCCCCAGTAATGCTGGGCACCCTAATACCA

CTCCTTCCTTCAGTGCCAAGAACAACTGCTCCCAAACTGTTTACCAGCTTTCCTCAGCATCTGA

ATTGCCTTTGAGATTAATTAAGCTAAAAGCATTTTTATATGGGAGAATATTATCAGCTTGTCCA

AGCAAAAATTTTAAATGTGAAAAACAAATTGTGTCTTAAGCATTTTTGAAAATTAAGGAAGAAG

AATTTGGGAAAAAATTAACGGTGGCTCAATTCTGTCTTCCAAATGATTTCTTTTCCCTCCTACT

CACATGGGTCGTAGGCCAGTGAATACATTCAACATGGTGATCCCCAGAAAACTCAGAGAAGCCT

CGGCTGATGATTAATTAAATTGATCTTTCGGCTACCCGAGAGAATTACATTTCCAAGAGACTTC

TTCACCAAAATCCAGATGGGTTTACATAAACTTCTGCCCACGGGTATCTCCTCTCTCCTAACAC

GCTGTGACGTCTGGGCTTGGTGGAATCTCAGGGAAGCATCCGTGGGGTGGAAGGTCATCGTCTG

GCTCGTTGTTTGATGGTTATATTACCATGCAATTTTCTTTGCCTACATTTGTATTGAATACATC

CCAATCTCCTTCCTATTCGGTGACATGACACATTCTATTTCAGAAGGCTTTGATTTTATCAAGC

ACTTTCATTTACTTCTCATGGCAGTGCCTATTACTTCTCTTACAATACCCATCTGTCTGCTTTA

CCAAAATCTATTTCCCCTTTTCAGATCCTCCCAAATGGTCCTCATAAACTGTCCTGCCTCCACC
```

-continued

```
TAGTGGTCCAGGTATATTTCCACAATGTTACATCAACAGGCACTTCTAGCCATTTTCCTTCTCA

AAAGGTGCAAAAAGCAACTTCATAAACACAAATTAAATCTTCGGTGAGGTAGTGTGATGCTGCT

TCCTCCCAACTCAGCGCACTTCGTCTTCCTCATTCCACAAAAACCCATAGCCTTCCTTCACTCT

GCAGGACTAGTGCTGCCAAGGGTTCAGCTCTACCTACTGGTGTGCTCTTTTGAGCAAGTTGCTT

AGCCTCTCTGTAACACAAGGACAATAGCTGCAAGCATCCCCAAAGATCATTGCAGGAGACAATG

ACTAAGGCTACCAGAGCCGCAATAAAAGTCAGTGAATTTTAGCGTGGTCCTCTCTGTCTCTCCA

GAACGGCTGCCACGTGGAATTGCTCTTCCTCCGCTACATCTCGGACTGGGACCTAGACCCTGGC

CGCTGCTACCGCGTCACCTGGTTCACCTCCTGGAGCCCCTGCTACGACTGTGCCCGACATGTGG

CCGACTTTCTGCGAGGGAACCCCAACCTCAGTCTGAGGATCTTCACCGCGCGCCTCTACTTCTG

TGAGGACCGCAAGGCTGAGCCCGAGGGGCTGCGGCGGCTGCACCGCGCCGGGGTGCAAATAGCC

ATCATGACCTTCAAAGGTGCGAAAGGGCCTTCCGCGCAGGCGCAGTGCAGCAGCCCGCATTCGG

GATTGCGATGCGGAATGAATGAGTTAGTGGGGAAGCTCGAGGGGAAGAAGTGGGCGGGGATTCT

GGTTCACCTCTGGAGCCGAAATTAAAGATTAGAAGCAGAGAAAAGAGTGAATGGCTCAGAGACA

AGGCCCCGAGGAAATGAGAAAATGGGGCCAGGGTTGCTTCTTTCCCCTCGATTTGGAACCTGAA

CTGTCTTCTACCCCCATATCCCCGCCTTTTTTTCCTTTTTTTTTTTTGAAGATTATTTTTACT

GCTGGAATACTTTTGTAGAAAACCACGAAAGAACTTTCAAAGCCTGGGAAGGGCTGCATGAAAA

TTCAGTTCGTCTCTCCAGACAGCTTCGGCGCATCCTTTTGGTAAGGGGCTTCCTCGCTTTTTAA

ATTTTCTTTCTTTCTCTACAGTCTTTTTTGGAGTTTCGTATATTTCTTATATTTTCTTATTGTT

CAATCACTCTCAGTTTTCATCTGATGAAAACTTTATTTCTCCTCCACATCAGCTTTTTCTTCTG

CTGTTTCACCATTCAGAGCCCTCTGCTAAGGTTCCTTTTCCCTCCCTTTTCTTTCTTTTGTTGT

TTCACATCTTTAAATTTCTGTCTCTCCCCAGGGTTGCGTTTCCTTCCTGGTCAGAATTCTTTTC

TCCTTTTTTTTTTTTTTTTTTTTTTTTTTTAAACAAACAAACAAAAAACCCAAAAAAACTCTTT

CCCAATTTACTTTCTTCCAACATGTTACAAAGCCATCCACTCAGTTTAGAAGACTCTCCGGCCC

CACCGACCCCCAACCTCGTTTTGAAGCCATTCACTCAATTTGCTTCTCTCTTTCTCTACAGCCC

CTGTATGAGGTTGATGACTTACGAGACGCATTTCGTACTTTGGGACTTTGATAGCAACTTCCAG

GAATGTCACACACGATGAAATATCTCTGCTGAAGACAGTGGATAAAAAACAGTCCTTCAAGTCT

TCTCTGTTTTTATTCTTCAACTCTCACTTTCTTAGAGTTTACAGAAAAAATATTTATATACGAC

TCTTTAAAAAGATCTATGTCTTGAAAATAGAGAAGGAACACAGGTCTGGCCAGGGACGTGCTGC

AATTGGTGCAGTTTTGAATGCAACATTGTCCCCTACTGGGAATAACAGAACTGCAGGACCTGGG

AGCATCCTAAAGTGTCAACGTTTTTCTATGACTTTTAGGTAGGATGAGAGCAGAAGGTAGATCC

TAAAAAGCATGGTGAGAGGATCAAATGTTTTTATATCAACATCCTTTATTATTTGATTCATTTG

AGTTAACAGTGGTGTTAGTGATAGATTTTTCTATTCTTTTCCCTTGACGTTTACTTTCAAGTAA

CACAAACTCTTCCATCAGGCCATGATCTATAGGACCTCCTAATGAGAGTATCTGGGTGATTGTG

ACCCCAAACCATCTCTCCAAAGCATTAATATCCAATCATGCGCTGTATGTTTAATCAGCAGAA

GCATGTTTTTATGTTTGTACAAAAGAAGATTGTTATGGGTGGGGATGGAGGTATAGACCATGCA

TGGTCACCTTCAAGCTACTTTAATAAAGGATCTTAAAATGGGCAGGAGGACTGTGAACAAGACA

CCCTAATAATGGGTTGATGTCTGAAGTAGCAAATCTTCTGGAAACGCAAACTCTTTTAAGGAAG

TCCCTAATTTAGAAACACCCACAAACTTCACATATCATAATTAGCAAACAATTGGAAGGAAGTT

GCTTGAATGTTGGGGAGAGGAAAATCTATTGGCTCTCGTGGGTCTCTTCATCTCAGAAATGCCA

ATCAGGTCAAGGTTTGCTACATTTTGTATGTGTGTGATGCTTCTCCCAAAGGTATATTAACTAT

ATAAGAGAGTTGTGACAAAACAGAATGATAAAGCTGCGAACCGTGGCACACGCTCATAGTTCTA
```

-continued

```
GCTGCTTGGGAGGTTGAGGAGGGAGGATGGCTTGAACACAGGTGTTCAAGGCCAGCCTGGGCAA

CATAACAAGATCCTGTCTCTCAAAAAAAAAAAAAAAAAAAAAGAAAGAGAGAGGGCCGGGCGTGG

TGGCTCACGCCTGTAATCCCAGCACTTTGGGAGGCCGAGCCGGGCGGATCACCTGTGGTCAGGA

GTTTGAGACCAGCCTGGCCAACATGGCAAAACCCCGTCTGTACTCAAAATGCAAAAATTAGCCA

GGCGTGGTAGCAGGCACCTGTAATCCCAGCTACTTGGGAGGCTGAGGCAGGAGAATCGCTTGAA

CCCAGGAGGTGGAGGTTGCAGTAAGCTGAGATCGTGCCGTTGCACTCCAGCCTGGGCGACAAGA

GCAAGACTCTGTCTCAGAAAAAAAAAAAAAAAAAAGAGAGAGAGAGAGAAAGAGAACAATATTTGG

GAGAGAAGGATGGGGAAGCATTGCAAGGAAATTGTGCTTTATCCAACAAAATGTAAGGAGCCAA

TAAGGGATCCCTATTTGTCTCTTTTGGTGTCTATTTGTCCCTAACAACTGTCTTTGACAGTGAG

AAAAATATTCAGAATAACCATATCCCTGTGCCGTTATTACCTAGCAACCCTTGCAATGAAGATG

AGCAGATCCACAGGAAAACTTGAATGCACAACTGTCTTATTTTAATCTTATTGTACATAAGTTT

GTAAAAGAGTTAAAAATTGTTACTTCATGTATTCATTTATATTTTATATTATTTTGCGTCTAAT

GATTTTTTATTAACATGATTTCCTTTTCTGATATATTGAAATGGAGTCTCAAAGCTTCATAAAT

TTATAACTTTAGAAATGATTCTAATAACAACGTATGTAATTGTAACATTGCAGTAATGGTGCTA

CGAAGCCATTTCTCTTGATTTTTAGTAAACTTTTATGACAGCAAATTTGCTTCTGGCTCACTTT

CAATCAGTTAAATAAATGATAAATAATTTTGGAAGCTGTGAAGATAAAATACCAAATAAAATAA

TATAAAAGTGATTTATATGAAGTTAAAATAAAAAATCAGTATGATGGAATAAACTTG
```

Apolipoprotein B mRNA editing enzyme, catalytic polypeptide-like (APOBEC) is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. Many modified cytidine deaminases are commercially available, including but not limited to SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177).

Other exemplary deaminases that can be fused to Cas9 according to aspects of this disclosure are provided herein. It should be understood that, in some embodiments, the active domain of the respective sequence can be used, e.g., the domain without a localizing signal (nuclear localization sequence, without nuclear export signal, cytoplasmic localizing signal).

The term "deaminase" or "deaminase domain" as used herein, refers to a protein or enzyme that catalyzes a deamination reaction. In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytosine deaminase, catalyzing the hydrolytic deamination of cytosine to uracil. In some embodiments, the deaminase is an adenosine deaminase, which catalyzes the hydrolytic deamination of adenine to hypoxanthine. In some embodiments, the deaminase is an adenosine deaminase, which catalyzes the hydrolytic deamination of adenosine or adenine (A) to inosine (I). In some embodiments, the deaminase or deaminase domain is an adenosine deaminase catalyzing the hydrolytic deamination of adenosine or deoxyadenosine to inosine or deoxyinosine, respectively. In some embodiments, the adenosine deaminase catalyzes the hydrolytic deamination of adenosine in deoxyribonucleic acid (DNA). The adenosine deaminases (e.g., engineered adenosine deaminases, evolved adenosine deaminases) provided herein can be from any organism, such as a bacterium. In some embodiments, the adenosine deaminase is from a bacterium, such as *Escherichia coli, Staphylococcus aureus, Salmonella typhimurium, Shewanella putrefaciens, Haemophilus influenzae,* or *Caulobacter crescentus.*

In some embodiments, the deaminase or deaminase domain is a variant of a naturally occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, or at least 99.9% identical to a naturally occurring deaminase.

For example, deaminase domains are described in International PCT Application Nos. PCT/2017/045381 (WO 2018/027078) and PCT/US2016/058344 (WO 2017/ 070632), each of which is incorporated herein by reference for its entirety. Also, see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage"

Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017)), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

"Detect" refers to identifying the presence, absence or amount of the analyte to be detected.

By "detectable label" is meant a composition that when linked to a molecule of interest renders the latter detectable, via spectroscopic, photochemical, biochemical, immuno-chemical, or chemical means. For example, useful labels include radioactive isotopes, magnetic beads, metallic beads, colloidal particles, fluorescent dyes, electron-dense reagents, enzymes (for example, as commonly used in an enzyme-linked immunosorbent assay (ELISA)), biotin, digoxigenin, or haptens.

By "disease" is meant any condition or disorder that damages or interferes with the normal function of a cell, tissue, or organ. In one embodiment, the disease is a neoplasia or cancer. In some embodiments, the disease is a hematological cancer. By "hematological cancer" is meant a malignancy of immune system cells. In some embodiments, the hematological cancer is leukemia, myeloma, and/or lymphoma. Lymphomas and Leukemias are examples of "liquid cancers" or cancers present in the blood and are derived from the transformation of either a hematopoietic precursor in the bone marrow or a mature hematopoietic cell in the blood. Leukemias can be lymphoid or myeloid, and acute or chronic. In the case of myelomas, the transformed cell is a fully differentiated plasma cell that may be present as a dispersed collection of malignant cells or as a solid mass in the bone marrow. In the case of lymphomas, a trans-formed lymphocyte in a secondary lymphoid tissue gener-ates a solid mass. Lymphomas are classified either Hodgkin lymphoma (HL) or non-Hodgkin lymphoma (NHL).

In some embodiments, the hematological cancer is a B cell cancer. In some embodiments, the B cell cancer is a lymphoma or a leukemia. In some cases, the leukemia comprises a pre-leukemia. In some cases, the leukemia is an acute leukemia. Acute leukemias include, for example, an acute myeloid leukemia (AML). Acute leukemias also include, for example, an acute lymphoid leukemia or an acute lymphocytic leukemia (ALL); ALL includes B-lineage ALL; T-lineage ALL; and T-cell acute lymphocytic leukemia (T-ALL).

Nonlimiting examples of diseases include T-cell acute lymphoblastic leukemia (T-ALL), mycosis fungoides (MF), Sézary syndrome (SS), Peripheral T/NK-cell lymphoma, Anaplastic large cell lymphoma ALK⁺, Primary cutaneous T-cell lymphoma, T-cell large granular lymphocytic leuke-mia, Angioimmunoblastic T/NK-cell lymphoma, Hepa-tosplenic T-cell lymphoma, Primary cutaneous CD30⁺ lym-phoproliferative disorders, Extranodal NK/T-cell lymphoma, Adult T-cell leukemia/lymphoma, T-cell prolym-phocytic leukemia, Subcutaneous panniculitis-like T-cell lymphoma, Primary cutaneous gamma-delta T-cell lym-phoma, Aggressive NK-cell leukemia, and Enteropathy-associated T-cell lymphoma. In some embodiments, the disease is a liquid tumor. In some embodiments, the disease is T-cell acute lymphoblastic leukemia (T-ALL). In some embodiments, the disease is acute myelogenous leukemia (AML).

The term "effective amount," as used herein, refers to an amount of a biologically active agent that is sufficient to elicit a desired biological response. In some embodiments, an effect amount is an amount required to ameliorate the symptoms of a disease relative to an untreated patient. The effective amount of an active agent(s) used to practice the present invention for therapeutic treatment of a disease varies depending upon the manner of administration, the age, body weight, and general health of the subject. Ulti-mately, the attending physician or veterinarian will decide the appropriate amount and dosage regimen. Such amount is referred to as an "effective" amount. In one embodiment, an effective amount is the amount of a base editor of the invention (e.g., a fusion protein comprising a programable DNA binding protein, a nucleobase editor and gRNA) sufficient to introduce an alteration in a gene of interest in a cell (e.g., a cell in vitro or in vivo). In one embodiment, an effective amount is the amount of a base editor required to achieve a therapeutic effect (e.g., to reduce or control a disease or a symptom or condition thereof). Such therapeutic effect need not be sufficient to alter a gene of interest in all cells of a subject, tissue or organ, but only to alter a gene of interest in about 1%, 5%, 10%, 25%, 50%, 75% or more of the cells present in a subject, tissue or organ.

In some embodiments, an effective amount of a fusion protein provided herein, e.g., of a nucleobase editor com-prising a nCas9 domain and a deaminase domain (e.g., adenosine deaminase or cytidine deaminase) refers to the amount of the fusion protein that is sufficient to induce editing of a target site specifically bound and edited by the nucleobase editors described herein. As will be appreciated by the skilled artisan, the effective amount of an agent, e.g., a fusion protein, a nuclease, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and/or on the agent being used. In the context of a CAR-T cell, "an effective amount refers" to the quantity of cells necessary to administer to a patient to achieve a therapeutic response.

"Epitope," as used herein, means an antigenic determi-nant. An epitope is the part of an antigen molecule that by its structure determines the specific antibody molecule that will recognize and bind it.

By "Fas Cell Surface Death Receptor (FAS) polypeptide" is meant a protein having at least about 85% amino acid sequence identity to NCBI Accession No. NP_000034.1 or fragment thereof. An exemplary amino acid sequence is provided below.

```
>NP_000034.1 tumor necrosis factor receptor super-
family member 6 isoform 1 precursor [Homo sapiens]
  1 MLGIWTLLPL VLTSVARLSS KSVNAQVTDI NSKGLELRKT

VTTVETQNLE GLHHDGQFCH

61 KPCPPGERKA RDCTVNGDEP DCVPCQEGKE YTDKAHFSSK

CRRCRLCDEG HGLEVEINCT

121 RTQNTKCRCK PNFFCNSTVC EHCDPCTKCE HGIIKECTLT

SNTKCKEEGS RSNLGWLCLL

181 LLPIPLIVWV KRKEVQKTCR KHRKENQGSH ESPTLNPETV

AINLSDVDLS KYITTIAGVM
```

```
241 TLSQVKGFVR KNGVNEAKID EIKNDNVQDTAEQKVQLLRN

WHQLHGKKEA YDTLIKDLKK

301 ANLCTLAEKI QTIILKDITS DSENSNFRNE IQSLV
```

By "Fas Cell Surface Death Receptor (FAS) polynucleotide" is meant a nucleic acid encoding a FAS polypeptide. An exemplary FAS nucleic acid sequence is provided below.

```
>NM_000043.6 Homo sapiens Fas cell surface death
receptor (FAS), transcript variant 1, mRNA
    1  ctcttctccc gcgggttggt ggacccgctc agtacggagt tggggaagct ctttcacttc 61  ggaggattgc tcaacaacca tgctgggcat ctggaccctc ctacctctgg ttcttacgtc 121  tgttgctaga ttatcgtcca aaagtgttaa tgcccaagtg actgacatca actccaaggg 181  attggaattg aggaagactg ttactacagt tgagactcag aacttggaag gcctgcatca 241  tgatggccaa ttctgccata agccctgtcc tccaggtgaa aggaaagcta gggactgcac 301  agtcaatggg gatgaaccag actgcgtgcc ctgccaagaa gggaaggagt acacagacaa 361  agcccatttt tcttccaaat gcagaagatg tagattgtgt gatgaaggac atggcttaga 421  agtggaaata aactgcaccc ggacccagaa taccaagtgc agatgtaaac caaacttttt 481  ttgtaactct actgtatgtg aacactgtga cccttgcacc aaatgtgaac atggaatcat 541  caaggaatgc acactcacca gcaacaccaa gtgcaaagag gaaggatcca gatctaactt 601  ggggtggctt tgtcttcttc ttttgccaat tccactaatt gtttgggtga agagaaagga 661  agtacagaaa acatgcagaa agcacagaaa ggaaaaccaa ggttctcatg aatctccaac 721  tttaaatcct gaaacagtgg caataaattt atctgatgtt gacttgagta aatatatcac 781  cactattgct ggagtcatga cactaagtca agttaaaggc tttgttcgaa agaatggtgt 841  caatgaagcc aaaaatagatg agatcaagaa tgacaatgtc caagacacag cagaacagaa 901  agttcaactg cttcgtaatt ggcatcaact tcatggaaag aaagaagcgt atgacacatt
```

```
  961  gattaaagat ctcaaaaaag ccaatctttg tactcttgca gagaaaattc agactatcat 1021  cctcaaggac attactagtg actcagaaaa ttcaaacttc agaaatgaaa tccaaagctt 1081  ggtctagagt gaaaaacaac aaattcagtt ctgagtatat gcaattagtg tttgaaaaga 1141  ttcttaatag ctggctgtaa atactgcttg gtttttttact gggtacattt tatcatttat 1201  tagcgctgaa gagccaacat atttgtagat ttttaatatc tcatgattct gcctccaagg 1261  atgtttaaaa tctagttggg aaaacaaact tcatcaagag taaatgcagt ggcatgctaa 1321  gtacccaaat aggagtgtat gcagaggatg aaagattaag attatgctct ggcatctaac 1381  atatgattct gtagtatgaa tgtaatcagt gtatgttagt acaaatgtct atccacaggc 1441  taaccccact ctatgaatca atagaagaag ctatgacctt ttgctgaaat atcagttact 1501  gaacaggcag gccactttgc ctctaaatta cctctgataa ttctagagat tttaccatat 1561  ttctaaactt tgtttataac tctgagaaga tcatatttat gtaaagtata tgtatttgag 1621  tgcagaattt aaataaggct ctacctcaaa gacctttgca cagtttattg gtgtcatatt 1681  atacaatatt tcaattgtga attcacatag aaaacattaa attataatgt ttgactatta 1741  tatatgtgta tgcattttac tggctcaaaa ctacctactt ctttctcagg catcaaaagc 1801  attttgagca ggagagtatt actagagctt tgccacctct ccatttttgc cttggtgctc 1861  atcttaatgg cctaatgcac ccccaaacat ggaaatatca ccaaaaaata cttaatagtc 1921  caccaaaagg caagactgcc cttagaaatt ctagcctggt ttggagatac taactgctct 1981  cagagaaagt agctttgtga catgtcatga acccatgttt gcaatcaaag atgataaaat 2041  agattcttat ttttcccca ccccgaaaa tgttcaataa tgtcccatgt aaaacctgct 2101  acaaatggca gcttatacat agcaatggca aaatcatcat ctggatttag gaattgctct
```

-continued
```
2161  tgtcataccc ccaagtttct aagatttaag attctcctta ctactatcct acgtttaaat 2221  atctttgaaa gtttgtatta aatgtgaatt ttaagaaata atatttatat ttctgtaaat 2281  gtaaactgtg aagatagtta taaactgaag cagatacctg gaaccaccta aagaacttcc 2341  atttatggag gatttttttg ccccttgtgt ttggaattat aaaatatagg taaaagtacg 2401  taattaaata atgtttttgg tatttctggt tttctctttt ttggtagggg cttgcttttt 2461  ggttttgtct tcctttttctc taactgatgc taaatataac ttgtctttaa tgcttcttgg 2521  atcccttaga aggtacttcc ttttaacct taacccttt agtagttaaa taattatttc 2581  cataggttgc tattgccaag aagacctctt ccaaacagca catgattatt cgtcaaacag 2641  tttcgtattc cagatactgg aatgtggata agaaagtata catttcaagg ggtaggtttt 2701  attattaaga aagccaaatg aggattttga aatattcttt cctgcatatt atccattcta 2761  gctacatgct ggccagtggg ccacctttct tttctgcaat ttaatgctag taatatattc 2821  tatttaaccc atgagtccca aagtattagc atttcaacat gtaagcatgt cggtaagata 2881  gttgtgcttt gcttagggtt ccctcctgtg ttatggtctg gaaagtgtct ttaggcagaa 2941  agtctgagtg atcacagggt tcactcatta atttctcttt tctgagccat catagtctgt 3001  gctgtctgct ctccagtttt ctatttctag acagaagtag ggcaagttag gtactagtta 3061  ttcttcatgg ccagaagtgc aagttctact ttgcaagaca agattaagtt agagaacacc 3121  ctattccact ttggtgaact cagagcaaga actttgagtt cctttgggag gaagacagtg 3181  gagaagtctt tgtacttggt gatgtggttt ttttcctcat ggcttcacct agtggcccca 3241  agcatgactt ctcccatatc aatgagcaca gccacattcc cgagttgagg tgacccacg 3301  gtccagaatc atcctcattc tggtgaacct ggttctcttt gtggtgggca tactgggtag
```

-continued
```
3361  gagaatcacc caaaggtcac ccatgagctg cagaaaaaaa ggctatttgc agaaggagct 3421  cacagatcac attgaaagca ttgcatattc aaacatcttg gtcttcttta ttggcatgcc 3481  cacagggtct tctgacctct gattagatca gacactttt agatattgaa tcatcagttt 3541  ctgtacaact atctgaataa ggtatataat caatgaaatt tagaattttt ttctatactt 3601  actcctgatt ggtaatttgt ttgggtttag aattctatac aaggccattt gtaattttcc 3661  tcagcacttt aaaaatatta aaccatgttt tcttaa
```

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

By "fratricide" is meant the killing of immune cells by other immune cells, including self-antigen driven killing of immune cells. In certain embodiments, immune cells of the invention are genetically modified to prevent or reduce expression of antigens recognized by immune cells expressing a chimeric antigen receptor (CAR), thereby preventing or reducing fratricide. In various embodiments, fratricide may occur in vivo (e.g., in a subject) or ex vivo (e.g., in an immune cell preparation).

"Graft versus host disease" (GVHD) refers to a pathological condition where transplanted cells of a donor generate an immune response against cells of the host.

By "guide RNA" or "gRNA" is meant a polynucleotide which can be specific for a target sequence and can form a complex with a polynucleotide programmable nucleotide binding domain protein (e.g., Cas9 or Cpf1). In an embodiment, the guide polynucleotide is a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821 (2012), the entire contents of which is incorporated herein by reference. Other examples of gRNAs (e.g., those including domain 2) can be found in US20160208288, entitled "Switchable Cas9 Nucleases and Uses Thereof," and U.S. Pat. No. 9,737,604, entitled "Delivery System For Functional Nucleases," the entire contents of each are hereby incorporated by reference in their entirety. In some embodiments, a gRNA comprises two or more of domains (1) and (2), and may be referred to as an "extended gRNA." An extended gRNA will bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. As will be appreciated by those skilled in the art, RNA polynucleotide sequences, e.g., gRNA sequences, include the nucleobase uracil (U), a pyrimidine derivative, rather than the nucleobase thymine (T), which is included in DNA polynucleotide sequences. In RNA, uracil base-pairs with adenine and replaces thymine during DNA transcription.

By "heterodimer" is meant a fusion protein comprising two domains, such as a wild type TadA domain and a variant of TadA domain (e.g., TadA*8) or two variant TadA domains (e.g., TadA*7.10 and TadA*8 or two TadA*8 domains).

"Host versus graft disease" (HVGD) refers to a pathological condition where the immune system of a host generates an immune response against transplanted cells of a donor.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

By "immune cell" is meant a cell of the immune system capable of generating an immune response.

By "immune effector cell" is meant a lymphocyte, once activated, capable of effecting an immune response upon a target cell. In some embodiments, immune effector cells are effector T cells. In some embodiments, the effector T cell is a naïve CD8+ T cell, a cytotoxic T cell, a natural killer T (NKT) cell, a natural killer (NK) cell, or a regulatory T (Treg) cell. In some embodiments, immune effector cells are effector NK cells. In some embodiments, the effector T cells are thymocytes, immature T lymphocytes, mature T lymphocytes, resting T lymphocytes, or activated T lymphocytes. In some embodiments the immune effector cell is a CD4⁺ CD8+ T cell or a CD4⁻ CD8⁻ T cell. In some embodiments the immune effector cell is a T helper cell. In some embodiments the T helper cell is a T helper 1 (Th1), a T helper 2 (Th2) cell, or a helper T cell expressing CD4 (CD4+ T cell).

By "immune response regulation gene" or "immune response regulator" is meant a gene that encodes a polypeptide that is involved in the regulation of an immune response. An immune response regulation gene may regulate immune response in multiple mechanisms or on different levels. For example, an immune response regulation gene may inhibit or facilitate the activation of an immune cell, e.g. a T cell. An immune response regulation gene may increase or decrease the activation threshold of an immune cell. In some embodiments, the immune response regulation gene positively regulates an immune cell signal transduction pathway. In some embodiments, the immune response regulation gene negatively regulates an immune cell signal transduction pathway. In some embodiments, the immune response regulation gene encodes an antigen, an antibody, a cytokine, or a neuroendocrine.

By "immunogenic gene" is meant a gene that encodes a polypeptide that is able to elicit an immune response. For example, an immunogenic gene may encode an immunogen that elicits an immune response. In some embodiments, an immunogenic gene encodes a cell surface protein. In some embodiments, an immunogenic gene encodes a cell surface antigen or a cell surface marker. In some embodiments, the cell surface marker is a T cell marker or a B cell marker. In some embodiments, an immunogenic gene encodes a CD2, CD3e, CD3 delta, CD3 gamma, TRAC, TRBC1, TRBC2, CD4, CD5, CD7, CD8, CD19, CD23, CD27, CD28, CD30, CD33, CD52, CD70, CD127, CD122, CD130, CD132, CD38, CD69, CD11a, CD58, CD99, CD103, CCR4, CCR5, CCR6, CCR9, CCR10, CXCR3, CXCR4, CLA, CD161, B2M, or CIITA polypeptide.

The term "inhibitor of base repair" or "IBR" refers to a protein that is capable in inhibiting the activity of a nucleic acid repair enzyme, for example a base excision repair (BER) enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG. In some embodiments, the base repair inhibitor is an inhibitor of Endo V or hAAG. In some embodiments, the base repair inhibitor is a catalytically inactive EndoV or a catalytically inactive hAAG.

In some embodiments, the base repair inhibitor is uracil glycosylase inhibitor (UGI). UGI refers to a protein that is capable of inhibiting a uracil-DNA glycosylase base-excision repair enzyme. In some embodiments, a UGI domain comprises a wild-type UGI or a fragment of a wild-type UGI. In some embodiments, the UGI proteins provided herein include fragments of UGI and proteins homologous to a UGI or a UGI fragment. In some embodiments, the base repair inhibitor is an inhibitor of inosine base excision repair. In some embodiments, the base repair inhibitor is a "catalytically inactive inosine specific nuclease" or "dead inosine specific nuclease. Without wishing to be bound by any particular theory, catalytically inactive inosine glycosylases (e.g., alkyl adenine glycosylase (AAG)) can bind inosine, but cannot create an abasic site or remove the inosine, thereby sterically blocking the newly formed inosine moiety from DNA damage/repair mechanisms. In some embodiments, the catalytically inactive inosine specific nuclease can be capable of binding an inosine in a nucleic acid but does not cleave the nucleic acid. Non-limiting exemplary catalytically inactive inosine specific nucleases include catalytically inactive alkyl adenosine glycosylase (AAG nuclease), for example, from a human, and catalytically inactive endonuclease V (EndoV nuclease), for example, from *E. coli*. In some embodiments, the catalytically inactive AAG nuclease comprises an E125Q mutation or a corresponding mutation in another AAG nuclease.

By "increases" is meant a positive alteration of at least 10%, 25%, 50%, 75%, or 100%.

An "intein" is a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein (e.g., split intein-N and split intein-C). For example, in cyanobacteria, DnaE, the catalytic subunit a of DNA polymerase III, is encoded by two separate genes, dnaE-n and dnaE-c. The intein encoded by the dnaE-n gene may be herein referred as "intein-N." The intein encoded by the dnaE-c gene may be herein referred as "intein-C."

Other intein systems may also be used. For example, a synthetic intein based on the dnaE intein, the Cfa-N (e.g., split intein-N) and Cfa-C (e.g., split intein-C) intein pair, has been described (e.g., in Stevens et al., J Am Chem Soc. 2016 Feb. 24; 138(7):2162-5, incorporated herein by reference). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference.

Exemplary nucleotide and amino acid sequences of inteins are provided below.

```
DnaE Intein-N DNA:
TGCCTGTCATACGAAACCGAGATACTGACAGTAGAATATGGCCTTCTGCC

AATCGGGAAGATTGTGGAGAAACGGATAGAATGCACAGTTTACTCTGTCG

ATAACAATGGTAACATTTATACTCAGCCAGTTGCCCAGTGGCACGACCGG

GGAGAGCAGGAAGTATTCGAATACTGTCTGGAGGATGGAAGTCTCATTAG

GGCCACTAAGGACCACAAATTTATGACAGTCGATGGCCAGATGCTGCCTA

TAGACGAAATCTTTGAGCGAGAGTTGGACCTCATGCGAGTTGACAACCTT

CCTAAT

DnaE Intein-N Protein:
CLSYETEILTVEYGLLPIGKIVEKRIECTVYSVDNNGNIYTQPVAQWHDR

GEQEVFEYCLEDGSLIRATKDHKFMTVDGQMLPIDEIFERELDLMRVDNL

PN

DnaE Intein-C DNA:
ATGATCAAGATAGCTACAAGGAAGTATCTTGGCAAACAAAACGTTTATGA

TATTGGAGTCGAAAGAGATCACAACTTTGCTCTGAAGAACGGATTCATAG

CTTCTAAT

Intein-C:
MIKIATRKYLGKQNVYDIGVERDHNFALKNGFIASN

Cfa-N DNA:
TGCCTGTCTTATGATACCGAGATACTTACCGTTGAATATGGCTTCTTGCC

TATTGGAAAGATTGTCGAAGAGAGAATTGAATGCACAGTATATACTGTAG

ACAAGAATGGTTTCGTTTACACACAGCCCATTGCTCAATGGCACAATCGC

GGCGAACAAGAAGTATTTGAGTACTGTCTCGAGGATGGAAGCATCATACG

AGCAACTAAAGATCATAAATTCATGACCACTGACGGGCAGATGTTGCCAA

TAGATGAGATATTCGAGCGGGGCTTGGATCTCAAACAAGTGGATGGATTG

CCA

Cfa-N Protein:
CLSYDTEILTVEYGFLPIGKIVEERIECTVYTVDKNGFVYTQPIAQWHNR

GEQEVFEYCLEDGSIIRATKDHKFMTTDGQMLPIDEIFERGLDLKQVDGL

P

Cfa-C DNA:
ATGAAGAGGACTGCCGATGGATCAGAGTTTGAATCTCCCAAGAAGAAGAG

GAAAGTAAAGATAATATCTCGAAAAAGTCTTGGTACCCAAAATGTCTATG

ATATTGGAGTGGAGAAAGATCACAACTTCCTTCTCAAGAACGGTCTCGTA

GCCAGCAAC
```

-continued
```
Cfa-C Protein:
MKRTADGSEFESPKKKRKVKIISRKSLGTQNVYDIGVEKDHNFLLKNGLV

ASN
```

Intein-N and intein-C may be fused to the N-terminal portion of the split Cas9 and the C-terminal portion of the split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N—[N-terminal portion of the split Cas9]-[intein-N]—C. In some embodiments, an intein-C is fused to the N-terminus of the C-terminal portion of the split Cas9, i.e., to form a structure of N-[intein-C]—[C-terminal portion of the split Cas9]-C. The mechanism of intein-mediated protein splicing for joining the proteins the inteins are fused to (e.g., split Cas9) is known in the art, e.g., as described in Shah et al., Chem Sci. 2014; 5(1):446-461, incorporated herein by reference. Methods for designing and using inteins are known in the art and described, for example by WO2014004336, WO2017132580, US20150344549, and US20180127780, each of which is incorporated herein by reference in their entirety.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high-performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis. By "leader peptide" is meant a short amino acid sequence (e.g., approximately 16-30 amino acids in length) that directs newly synthesized secretory or membrane proteins to and through membranes (e.g., the endoplasmic reticulum membrane). Leader peptides are typically located at the N-terminus of a polypeptide and can be removed by signal peptidases after the polypeptide has crossed the membrane. Leader peptide sequences typically contain three common structural features: N-terminal polar basic region (n-region), a hydrophobic core, and a hydrophilic c-region). In some embodiments, a CAR of the present invention includes a leader peptide sequence (e.g., N-terminal to the antigen binding domain). An exemplary leader peptide amino acid sequence is: METDTLLLWVLLLWVPGSTG (SEQ ID NO: 55).

The term "linker," as used herein, refers to a bond (e.g., covalent bond), chemical group, or a molecule linking two molecules or moieties, e.g., two components of a protein complex or a ribonucleocomplex, or two domains of a fusion protein, such as, for example, a polynucleotide programmable DNA binding domain (e.g., dCas9) and a deaminase domain (e.g., an adenosine deaminase, a cytidine deaminase). A linker can join different components of, or different portions of components of, a base editor system. For example, in some embodiments, a linker can join a guide polynucleotide binding domain of a polynucleotide programmable nucleotide binding domain and a catalytic domain of a deaminase. In some embodiments, a linker can join a CRISPR polypeptide and a deaminase. In some embodiments, a linker can join a Cas9 and a deaminase. In some embodiments, a linker can join a dCas9 and a deaminase. In some embodiments, a linker can join a nCas9 and a deaminase. In some embodiments, a linker can join a guide polynucleotide and a deaminase. In some embodiments, a linker can join a deaminating component and a polynucleotide programmable nucleotide binding component of a base editor system. In some embodiments, a linker can join an RNA-binding portion of a deaminating component and a polynucleotide programmable nucleotide binding component of a base editor system. In some embodiments, a linker can join an RNA-binding portion of a deaminating component and an RNA-binding portion of a polynucleotide programmable nucleotide binding component of a base editor system. A linker can be positioned between, or flanked by, two groups, molecules, or other moieties and connected to each one via a covalent bond or non-covalent interaction, thus connecting the two. In some embodiments, the linker can be an organic molecule, group, polymer, or chemical moiety. In some embodiments, the linker can be a polynucleotide. In some embodiments, the linker can be a DNA linker. In some embodiments, the linker can be an RNA linker. In some embodiments, a linker can comprise an aptamer capable of binding to a ligand. In some embodiments, the ligand may be carbohydrate, a peptide, a protein, or a nucleic acid. In some embodiments, the linker may comprise an aptamer may be derived from a riboswitch. The riboswitch from which the aptamer is derived may be selected from a theophylline riboswitch, a thiamine pyrophosphate (TPP) riboswitch, an adenosine cobalamin (AdoCbl) riboswitch, an S-adenosyl methionine (SAM) riboswitch, an SAH riboswitch, a flavin mononucleotide (FMN) riboswitch, a tetrahydrofolate riboswitch, a lysine riboswitch, a glycine riboswitch, a purine riboswitch, a GlmS riboswitch, or a pre-queosine1 (PreQ1) riboswitch. In some embodiments, a linker may comprise an aptamer bound to a polypeptide or a protein domain, such as a polypeptide ligand. In some embodiments, the polypeptide ligand may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or an RNA recognition motif In some embodiments, the polypeptide ligand may be a portion of a base editor system component. For example, a nucleobase editing component may comprise a deaminase domain and an RNA recognition motif.

In some embodiments, the linker can be an amino acid or a plurality of amino acids (e.g., a peptide or protein). In some embodiments, the linker can be about 5-100 amino acids in length, for example, about 5, 6, 7, 8, 9, 10, 11, 12, 13, 14, 15, 16, 17, 18, 19, 20, 20-30, 30-40, 40-50, 50-60, 60-70, 70-80, 80-90, or 90-100 amino acids in length. In some embodiments, the linker can be about 100-150, 150-200, 200-250, 250-300, 300-350, 350-400, 400-450, or 450-500 amino acids in length. Longer or shorter linkers can be also contemplated.

In some embodiments, a linker joins a gRNA binding domain of an RNA-programmable nuclease, including a Cas9 nuclease domain, and the catalytic domain of a nucleic-acid editing protein (e.g., cytidine or adenosine deaminase). In some embodiments, a linker joins a dCas9 and a nucleic-acid editing protein. For example, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated. In some embodiments, a linker comprises the amino acid sequence SGSETPGTSESATPES (SEQ ID NO: 56), which may also be referred to as the XTEN linker. In some embodiments, a linker comprises the amino acid sequence SGGS (SEQ ID NO: 57). In some embodiments, a linker comprises (SGGS)$_n$ (SEQ ID NO: 58), (GGGS)$_n$ (SEQ ID NO: 59), (GGGGS)$_n$ (SEQ ID NO: 60), (G)$_n$ (SEQ ID NO: 61), (EAAAK)$_n$ (SEQ ID NO: 62), (GGS)$_n$ (SEQ ID NO: 63), SGSETPGTSESAT-PES (SEQ ID NO: 56), or (XP)$_n$ (SEQ ID NO: 64) motif, or a combination of any of these, where n is independently an integer between 1 and 30, and where X is any amino acid. In some embodiments, n is 1, 2, 3, 4, 5, 6, 7, 8, 9, 10, 11, 12, 13, 14, or 15. In some embodiments, a linker comprises a plurality of proline residues and is 5-21, 5-14, 5-9, 5-7 amino acids in length, e.g., PAPAP (SEQ ID NO: 65), PAPAPA (SEQ ID NO: 66), PAPAPAP (SEQ ID NO: 67), PAPAPAPA (SEQ ID NO: 68), P(AP)$_4$ (SEQ ID NO: 69), P(AP)$_7$ (SEQ ID NO: 70), P(AP)$_{10}$ (SEQ ID NO: 71). Such proline-rich linkers are also termed "rigid" linkers.

In some embodiments, the chimeric antigen receptor comprises at least one linker. The at least one linker joins, or links, a variable heavy (VH) region to a constant heavy (CH) region of the extracellular binding domain of the chimeric antigen receptor. Linkers can also link a variable light (VL) region to a variable constant (VC) region of the extracellular binding domain.

In some embodiments, the domains of the base editor are fused via a linker that comprises the amino acid sequence of: IDC-59 DNA

SGGSSGSETPGTSESATPESSGGS,

SGGSSGGSSGSETPGTSESATPESSGGSSGGS,
or

GGSGGSPGSPAGSPTSTEEGTSESATPESGPGTSTEPSEGSAPGSPAGSP

TSTEEGTSTEPSEGSAPGTSTEPSEGSAPGTSESATPESGPGSEPATSGG

SGGS.

In some embodiments, domains of the base editor are fused via a linker comprising the amino acid sequence SGSETPGTSESATPES (SEQ ID NO: 56), which may also be referred to as the XTEN linker. In some embodiments, a linker comprises the amino acid sequence SGGS (SEQ ID NO: 57). In some embodiments, the linker is 24 amino acids in length. In some embodiments, the linker comprises the amino acid sequence SGGSSGGSSGSETPGTSESATPES (SEQ ID NO: 75). In some embodiments, the linker is 40 amino acids in length. In some embodiments, the linker comprises the amino acid sequence SGGSSGGSSG-SETPGTSESATPESSGGSSGGSSGGSSGGS (SEQ ID NO: 76).In some embodiments, the linker is 64 amino acids in length. In some embodiments, the linker comprises the amino acid sequence SGGSSGGSSGSETPGTSESAT-PESSGGSSGGSSGGSSGGSSGSETPGTSESATPESS-GGS (SEQ ID NO: 77) SGGS. In some embodiments, the linker is 92 amino acids in length. In some embodiments, the linker comprises the amino acid sequence

PGSPAGSPTSTEEGTSESATPESGPGTSTEPSEGSAPGSPAGSPTSTEEG

TSTEPSEGSAPGTSTEPSEGSAPGTSESATPESGPGSEPATS.

The term "liquid cancer" as used herein refers to cancer cells that are present in body fluids, such as, for example, blood, lymph, and bone marrow. Liquid cancers include, but are not limited to, leukemias, myelomas, and liquid lymphomas. Liquid cancers as used herein do not include solid tumors, such as sarcomas and carcinomas, or solid lymphomas that do not contain cysts or liquid areas. A "liquid cancer" can be relapsed, refractory, or metastatic. A liquid cancer to be treated with the methods described herein can be, for example, a liquid lymphoma; liquid lymphomas include lymphomas that contain cysts or liquid areas.

By "Lymphocyte-activation gene 3 (LAG-3) polypeptide" is meant a protein having at least about 85% amino acid sequence identity to NCBI Accession No. NP_002277.4 or fragment thereof and having immunomodulatory activity. An exemplary amino acid sequence is provided below.

```
>NP_002277.4 lymphocyte activation gene 3 protein
precursor [Homo sapiens]
  1  MWEAQFLGLL FLQPLWVAPV KPLQPGAEVP VVWAQEGAPA

QLPCSPTIPL QDLSLLRRAG
```

-continued
```
 61 VTWQHQPDSG PPAAAPGHPL APGPHPAAPS SWGPRPRRYT

VLSVGPGGLR SGRLPLQPRV

121 QLDERGRQRG DFSLWLRPAR RADAGEYRAA VHLRDRALSC

RLRLRLGQAS MTASPPGSLR

181 ASDWVILNCS FSRPDRPASV HWFRNRGQGR VPVRESPHHH

LAESFLFLPQ VSPMDSGPWG

241 CILTYRDGFN VSIMYNLTVL GLEPPTPLTV YAGAGSRVGL

PCRLPAGVGT RSFLTAKWTP

301 PGGGPDLLVTGDNGDFTLRL EDVSQAQAGT YTCHIHLQEQ

QLNATVTLAI ITVTPKSFGS

361 PGSLGKLLCE VTPVSGQERF VWSSLDTPSQ RSFSGPWLEA

QEAQLLSQPW QCQLYQGERL

421 LGAAVYFTEL SSPGAQRSGR APGALPAGHL LLFLILGVLS

LLLLVTGAFG FHLWRRQWRP

481 RRFSALEQGI HPPQAQSKIE ELEQEPEPEP EPEPEPEPEP

EPEQL
```

By "Lymphocyte-activation gene 3 (LAG-3) polynucleotide" is meant a nucleic acid encoding a LAG-3 polypeptide. An exemplary LAG-3 nucleic acid sequence is provided below.

```
>NM_002286.6 Homo sapiens lymphocyte activating
3 (LAG3), mRNA
   1  agagaccagc agaacggcat cccagccacg acggccactt tgctctgtct gctctccgcc 61  acggccctgc tctgttccct gggacacccc cgcccccacc tcctcaggct gcctgatctg 121  cccagctttc cagctttcct ctggattccg gcctctggtc atccctcccc accctctctc 181  caaggccctc tcctggtctc ccttcttcta gaaccccttc ctccacctcc ctctctgcag 241  aacttctcct ttacccccca ccccccacca ctgccccctt tccttttctg acctcctttt 301  ggagggctca gcgctgccca gaccatagga gagatgtggg aggctcagtt cctgggcttg 361  ctgtttctgc agccgctttg ggtggctcca gtgaagcctc tccagccagg ggctgaggtc 421  ccggtggtgt gggcccagga gggggctcct gcccagctcc cctgcagccc cacaatcccc 481  ctccaggatc tcagccttct gcgaagagca ggggtcactt ggcagcatca gccagacagt 541  ggcccgcccg ctgccgcccc cggccatccc ctggcccccg gccctcaccc ggcggcgccc
```

-continued
```
601  tcctcctggg ggcccaggcc ccgccgctac acggtgctga gcgtgggtcc cggaggcctg 661  cgcagcggga ggctgcccct gcagccccgc gtccagctgg atgagcgcgg ccggcagcgc 721  ggggacttct cgctatggct gcgcccagcc cggagcgcgg acgccggcga gtaccgcgcc 781  gcggtgcacc tcagggaccg cgccctctcc tgccgcctcc gtctgcgcct gggccaggcc 841  tcgatgactg ccagcccccc aggatctctc agagcctccg actgggtcat tttgaactgc 901  tccttcagcc gccctgaccg cccagcctct gtgcattggt tccggaaccg gggccagggc 961  cgagtccctg tccgggagtc cccccatcac cacttagcgg aaagcttcct cttcctgccc 1021 caagtcagcc ccatggactc tgggccctgg ggctgcatcc tcacctacag agatggcttc 1081 aacgtctcca tcatgtataa cctcactgtt ctgggtctgg agcccccaac tcccttgaca 1141 gtgtacgctg gagcaggttc cagggtgggg ctgccctgcc gcctgcctgc tggtgtgggg 1201 acccggtctt tcctcactgc caagtggact cctcctgggg gaggccctga cctcctgggg 1261 actggagaca atggcgactt tacccttcga ctagaggatg tgagccaggc ccaggctggg 1321 acctacacct gccatatcca tctgcaggaa cagcagctca atgccactgt cacattggca 1381 atcatcacag tgactcccaa atcctttggg tcacctggat ccctggggaa gctgctttgt 1441 gaggtgactc cagtatctgg acaagaacgc tttgtgtgga gctctctgga caccccatcc 1501 cagaggagtt tctcaggacc ttggctggag gcacaggagg cccagctcct ttcccagcct 1561 tggcaatgcc agctgtacca gggggagagg cttcttggag cagcagtgta cttcacagag 1621 ctgtctagcc caggtgccca acgctctggg agagcccag gtgccctccc agcaggccac 1681 ctcctgctgt ttctcatcct tggtgtcctt tctctgctcc ttttggtgac tggagccttt 1741 ggctttcacc tttgggagaag acagtggcga ccaagacgat tttctgcctt agagcaaggg
```

-continued
```
1801 attcaccctc cgcaggctca gagcaagata gaggagctgg agcaagaacc ggagccggag 1861 ccggagccgg aaccggagcc cgagcccgag ccagagccgg agcagctctg acctggagct 1921 gaggcagcca gcagatctca gcagcccagt ccaaataaac tccctgtcag cagcaa
```

By "marker" is meant any protein or polynucleotide having an alteration in expression level or activity that is associated with a disease or disorder.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)). In some embodiments, the presently disclosed base editors can efficiently generate an "intended mutation," such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., cytidine base editor or adenosine base editor) bound to a guide polynucleotide (e.g., gRNA), specifically designed to generate the intended mutation.

In general, mutations made or identified in a sequence (e.g., an amino acid sequence as described herein) are numbered in relation to a reference (or wild-type) sequence, i.e., a sequence that does not contain the mutations. The skilled practitioner in the art would readily understand how to determine the position of mutations in amino acid and nucleic acid sequences relative to a reference sequence.

"Neoplasia" refers to cells or tissues exhibiting abnormal growth or proliferation. The term neoplasia encompasses cancer, liquid and solid tumors. In some embodiments, the neoplasia is a solid tumor. In other embodiments, the neoplasia is a liquid tumor. In some embodiments, the neoplasia is a hematological cancer. In some embodiments, the hematological cancer is leukemia, myeloma, and/or lymphoma. In some embodiments, the hematological cancer is a B cell cancer. In some embodiments, the B cell cancer is a lymphoma or a leukemia. In some cases, the leukemia comprises a pre-leukemia. In some cases, the leukemia is an acute leukemia. Acute leukemias include, for example, an acute myeloid leukemia (AML). Acute leukemias also include, for example, an acute lymphoid leukemia or an acute lymphocytic leukemia (ALL); ALL includes B-lineage ALL; T-lineage ALL; and T-cell acute lymphocytic leukemia (T-ALL).

Nonlimiting examples of neoplasia include T-cell acute lymphoblastic leukemia (T-ALL), mycosis fungoides (MF), Sézary syndrome (SS), Peripheral T/NK-cell lymphoma, Anaplastic large cell lymphoma ALK[+], Primary cutaneous T-cell lymphoma, T-cell large granular lymphocytic leukemia, Angioimmunoblastic T/NK-cell lymphoma, Hepatosplenic T-cell lymphoma, Primary cutaneous CD30[+] lymphoproliferative disorders, Extranodal NK/T-cell lymphoma, Adult T-cell leukemia/lymphoma, T-cell prolymphocytic leukemia, Subcutaneous panniculitis-like T-cell lymphoma, Primary cutaneous gamma-delta T-cell lymphoma, Aggressive NK-cell leukemia, and Enteropathy-associated T-cell lymphoma. In some embodiments, the neoplasia is T-cell acute lymphoblastic leukemia (T-ALL). In some embodiments, the neoplasia is acute myelogenous leukemia (AML).

By "nuclear factor of activated T cells 1 (NFATc1) polypeptide" is meant a protein having at least about 85% amino acid sequence identity to NCBI Accession No. NM_172390.2 or a fragment thereof and is a component of the activated T cell DNA-binding transcription complex. An exemplary amino acid sequence is provided below.

```
>NP_765978.1 nuclear factor of activated T-cells,
cytoplasmic 1 isoform A [Homo sapiens]
MPSTSFPVPSKFPLGPAAAVFGRGETLGPAPRAGGTMKSAEEEHYGYASS

NVSPALPLPTAHSTLPAPCHNLQTSTPGIIPPADHPSGYGAALDGGPAGY

FLSSGHTRPDGAPALESPRIEITSCLGLYHNNNQFFHDVEVEDVLPSSKR

SPSTATLSLPSLEAYRDPSCLSPASSLSSRSCNSEASSYESNYSYPYASP

QTSPWQSPCVSPKTTDPEEGFPRGLGACTLLGSPRHSPSTSPRASVTEES

WIGARSSRPASPCNKRKYSLNGRQPPYSPHHSPTPSPHGSPRVSVTDDSW

LGNTTQYTSSAIVAAINALTTDSSLDLGDGVPVKSRKTTLEQPPSVALKV

EPVGEDLGSPPPPADFAPEDYSSFQHIRKGGFCDQYLAVPQHPYQWAKPK

PLSPTSYMSPTLPALDWQLPSHSGPYELRIEVQPKSHHRAHYETEGSRGA

VKASAGGHPIVQLHGYLENEPLMLQLFIGTADDRLLRPHAFYQVHRITGK

TVSTTSHEAILSNTKVLEIPLLPENSMRAVIDCAGILKLRNSDIELRKGE

TDIGRKNTRVRLVFRVHVPQPSGRTLSLQVASNPIECSQRSAQELPLVEK

QSTDSYPVVGGKKMVLSGHNFLQDSKVIFVEKAPDGHHVWEMEAKTDRDL

CKPNSLVVEIPPFRNQRITSPVHVSFYVCNGKRKRSQYQRFTYLPANGNA

IFLTVSREHERVGCFF
```

By "nuclear factor of activated T cells 1 (NFATc1) polynucleotide" is meant a nucleic acid molecule encoding a NFATc1 polypeptide. The NFATc1 gene encodes a protein that is involved in in the inducible expression of cytokine genes, especially IL-2 and IL-4, in T-cells. An exemplary nucleic acid sequenced is provided below.

```
>NM_172390.2 Homo sapiens nuclear factor of
activated T cells 1 (NFATC1), transcript
variant 1, mRNA
GGCGGGCGCTCGGCGACTCGTCCCCGGGGCCCCGCGCGGGCCCGGGCAGC

AGGGGCGTGATGTCACGGCAGGGAGGGGGCGCGGGAGCCGCCGGGCCGGC

GGGGAGGCGGGGGAGGTGTTTTCCAGCTTTAAAAAGGCAGGAGGCAGAGC

GCGGCCCTGCGTCAGAGCGAGACTCAGAGGCTCCGAACTCGCCGGCGGAG

TCGCCGCGCCAGATCCCAGCAGCAGGGCGCGGGCACCGGGGCGCGGGCAG

GGCTCGGAGCCACCGCGCAGGTCCTAGGGCCGCGGCCGGGCCCCGCCACG

CGCGCACACGCCCCTCGATGACTTTCCTCCGGGGCGCGCGGCGCTGAGCC

CGGGGCGAGGGCTGTCTTCCCGGAGACCCGACCCCGGCAGCGCGGGGCGG
```

```
CCGCTTCTCCTGTGCCTCCGCCCGCCGCTCCACTCCCCGCCGCCGCCGCG

CGGATGCCAAGCACCAGCTTTCCAGTCCCTTCCAAGTTTCCACTTGGCCC

TGCGGCTGCGGTCTTCGGGAGAGGAGAAACTTTGGGGCCCGCGCCGCGCG

CCGGCGGCACCATGAAGTCAGCGGAGGAAGAACACTATGGCTATGCATCC

TCCAACGTCAGCCCCGCCCTGCCGCTCCCCACGGCGCACTCCACCCTGCC

GGCCCCGTGCCACAACCTTCAGACCTCCACACCGGGCATCATCCCGCCGG

CGGATCACCCCTCGGGGTACGGAGCAGCTTTGGACGGTGGGCCCGCGGGC

TACTTCCTCTCCTCCGGCCACACCAGGCCTGATGGGGCCCCTGCCCTGGA

GAGTCCTCGCATCGAGATAACCTCGTGCTTGGGCCTGTACCACAACAATA

ACCAGTTTTTCCACGATGTGGAGGTGGAAGACGTCCTCCCTAGCTCCAAA

CGGTCCCCCTCCACGGCCACGCTGAGTCTGCCCAGCCTGGAGGCCTACAG

AGACCCCTCGTGCCTGAGCCCGGCCAGCAGCCTGTCCTCCCGGAGCTGCA

ACTCAGAGGCCTCCTCCTACGAGTCCAACTACTCGTACCCGTACGCGTCC

CCCCAGACGTCGCCATGGCAGTCTCCCTGCGTGTCTCCCAAGACCACGGA

CCCCGAGGAGGGCTTTCCCCGCGGGCTGGGGGCCTGCACACTGCTGGGTT

CCCCGCGGCACTCCCCCTCCACCTCGCCCCGCGCCAGCGTCACTGAGGAG

AGCTGGCTGGGTGCCCGCTCCTCCAGACCCGCGTCCCCTTGCAACAAGAG

GAAGTACAGCCTCAACGGCCGGCAGCCGCCcTACTCACCCCACCACTCGC

CCACGCCGTCCCCGCACGGcTCCCCGCGGGTCAGCGTGACCGACGACTCG

TGGTTGGGCAACACCACCCAGTACACCAGCTCGGCCATCGTGGCCGCCAT

CAACGCGCTGACCACCGACAGCAGCCTGGACCTGGGAGATGGCGTCCCTG

TCAAGTCCCGCAAGACCACCCTGGAGCAGCCGCCCTCAGTGGCGCTCAAG

GTGGAGCCCGTCGGGGAGGACCTGGGCAGCCCCCCGCCCCCCGGCCGACTT

CGCGCCCGAAGACTACTCCTCTTTCCAGCACATCAGGAAGGGCGGCTTCT

GCGACCAGTACCTGGCGGTGCCGCAGCACCCCTACCAGTGGGCGAAGCCC

AAGCCCCTGTCCCCTACGTCCTACATGAGCCCGACCCTGCCCGCCCTGGA

CTGGCAGCTGCCGTCCCACTCAGGCCCGTATGAGCTTCGGATTGAGGTGC

AGCCCAAGTCCCACCACCGAGCCCACTACGAGACGGAGGGCAGCCGGGGG

GCCGTGAAGGCGTCGGCCGGAGGACACCCCATCGTGCAGCTGCATGGCTA

CTTGGAGAATGAGCCGCTGATGCTGCAGCTTTTCATTGGGACGGCGGACG

ACCGCCTGCTGCGCCCGCACGCCTTCTACCAGGTGCACCGCATCACAGGG

AAGACCGTGTCCACCACCAGCCACGAGGCCATCCTCTCCAACACCAAAGT

CCTGGAGATCCCACTCCTGCCGGAGAACAGCATGCGAGCCGTCATTGACT

GTGCCGGAATCCTGAAACTCAGAAACTCCGACATTGAACTTCGGAAAGGA

GAGACGGACATCGGGAGGAAGAACACACGGGTACGGCTGGTGTTCCGCGT

TCACGTCCCGCAACCCAGCGGCCGCACGCTGTCCCTGCAGGTGGCCTCCA

ACCCCATCGAATGCTCCCAGCGCTCAGCTCAGGAGCTGCCTCTGGTGGAG

AAGCAGAGCACGGACAGCTATCCGGTCGTGGGCGGGAAGAAGATGGTCCT

GTCTGGCCACAACTTCCTGCAGGACTCCAAGGTCATTTTCGTGGAGAAAG

CCCCAGATGGCCACCATGTCTGGGAGATGGAAGCGAAAACTGACCGGGAC

CTGTGCAAGCCGAATTCTCTGGTGGTTGAGATCCCGCCATTTCGGAATCA
```

-continued

```
GAGGATAACCAGCCCCGTTCACGTCAGTTTCTACGTCTGCAACGGGAAGA

GAAAGCGAAGCCAGTACCAGCGTTTCACCTACCTTCCCGCCAACGGTAAC

GCCATCTTTCTAACCGTAAGCCGTGAACATGAGCGCGTGGGGTGCTTTTT

CTAAAGACGCAGAAACGACGTCGCCGTAAAGCAGCGTGGCGTGTTGCACA

TTTAACTGTGTGATGTCCCGTTAGTGAGACCGAGCCATCGATGCCCTGAA

AAGGAAAGGAAAAGGGAAGCTTCGGATGCATTTTCCTTGATCCCTGTTGG

GGGTGGGGGGCGGGGGTTGCATACTCAGATAGTCACGGTTATTTTGCTTC

TTGCGAATGTATAACAGCCAAGGGGAAAACATGGCTCTTCTGCTCCAAAA

AACTGAGGGGGTCCTGGTGTGCATTTGCACCCTAAAGCTGCTTACGGTGA

AAAGGCAAATAGGTATAGCTATTTTGCAGGCACCTTTAGGAATAAACTTT

GCTTTTAAGCCTGTAAAAAAAAAAAAAA
```

The term "non-conservative mutations" involve amino acid substitutions between different groups, for example, lysine for tryptophan, or phenylalanine for serine, etc. In this case, it is preferable for the non-conservative amino acid substitution to not interfere with, or inhibit the biological activity of, the functional variant. The non-conservative amino acid substitution can enhance the biological activity of the functional variant, such that the biological activity of the functional variant is increased as compared to the wild-type protein.

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence

```
PKKKRKVEGADKRTADGSEFESPKKKRKV,

KRTADGSEFESPKKKRKV,

KRPAATKKAGQAKKKK,

KKTELQTTNAENKTKKL,

KRGINDRNFWRGENGRKTR,

RKSGKIAAIVVKRPRK,

PKKKRKV,
or

MDSLLMNRRKFLYQFKNVRWAKGRRETYLC.
```

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides).

In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages). The term "nucleic acid programmable DNA binding protein" or "napDNAbp" may be used interchangeably with "polynucleotide programmable nucleotide binding domain" to refer to a protein that associates with a nucleic acid (e.g., DNA or RNA), such as a guide nucleic acid or guide polynucleotide (e.g., gRNA), that guides the napDNAbp to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. A Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Non-limiting examples of nucleic acid programmable DNA binding proteins include, Cas9 (e.g., dCas9 and nCas9), Cas12a/Cpf1, Cas12b/C2cl, Cas12c/C2c3, Cas12d/CasY, Cas12e/CasX, Cas12g, Cas12h, Cas12i, and Cas12j/CasΦ. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2cl, Cas12c/C2c3, Cas12d/CasY, Cas12e/CasX, Cas12g, Cas12h, Cas12i, Cas12j/CasΦ, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" *CRISPR J.* 2018 October; 1:325-336. doi: 10.1089/crispr.2018.0033; Yan et al., "Functionally diverse type V CRISPR-Cas systems" *Science.* 2019 Jan. 4; 363(6422):88-91. doi: 10.1126/science.aav7271, the entire contents of each are hereby incorporated by reference.

The term "nucleobase," "nitrogenous base," or "base," used interchangeably herein, refers to a nitrogen-containing biological compound that forms a nucleoside, which in turn is a component of a nucleotide. The ability of nucleobases to form base pairs and to stack one upon another leads directly to long-chain helical structures such as ribonucleic acid (RNA) and deoxyribonucleic acid (DNA). Five nucleobases—adenine (A), cytosine (C), guanine (G), thymine (T), and uracil (U)—are called primary or canonical. Adenine and guanine are derived from purine, and cytosine, uracil, and thymine are derived from pyrimidine. DNA and RNA can also contain other (non-primary) bases that are modified. Non-limiting exemplary modified nucleobases can include hypoxanthine, xanthine, 7-methylguanine, 5,6-dihydrouracil, 5-methylcytosine (m5C), and 5-hydromethylcytosine. Hypoxanthine and xanthine can be created through mutagen presence, both of them through deamination (replacement of the amine group with a carbonyl group). Hypoxanthine can be modified from adenine. Xanthine can be modified from guanine. Uracil can result from deamination of cytosine. A "nucleoside" consists of a nucleobase and a five carbon sugar (either ribose or deoxyribose). Examples of a nucleoside include adenosine, guanosine, uridine, cytidine, 5-methyluridine (m5U), deoxyadenosine, deoxyguanosine, thymidine, deoxyuridine, and deoxycytidine. Examples of a nucleoside with a modified nucleobase includes inosine (I), xanthosine (X), 7-methylguanosine (m7G), dihydrouridine (D), 5-methylcytidine (m5C), and pseudouridine (Ψ). A "nucleotide" consists of a nucleobase, a five carbon sugar (either ribose or deoxyribose), and at least one phosphate group.

The terms "nucleobase editing domain" or "nucleobase editing protein," as used herein, refers to a protein or enzyme that can catalyze a nucleobase modification in RNA or DNA, such as cytosine (or cytidine) to uracil (or uridine) or thymine (or thymidine), and adenine (or adenosine) to hypoxanthine (or inosine) deaminations, as well as non-templated nucleotide additions and insertions. In some embodiments, the nucleobase editing domain is a deaminase domain (e.g., an adenine deaminase or an adenosine deaminase; or a cytidine deaminase or a cytosine deaminase). In some embodiments, the nucleobase editing domain is more than one deaminase domain (e.g., an adenine deaminase or an adenosine deaminase and a cytidine or a cytosine deaminase). In some embodiments, the nucleobase editing domain can be a naturally occurring nucleobase editing domain. In some embodiments, the nucleobase editing domain can be an engineered or evolved nucleobase editing domain from the naturally occurring nucleobase editing domain. The nucleobase editing domain can be from any organism, such as a bacterium, human, chimpanzee, gorilla, monkey, cow, dog, rat, or mouse.

As used herein, "obtaining" as in "obtaining an agent" includes synthesizing, purchasing, or otherwise acquiring the agent. A "patient" or "subject" as used herein refers to a mammalian subject or individual diagnosed with, at risk of having or developing, or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, camels, llamas, goats, sheep, rodents (e.g., mice, rabbits, rats, or guinea pigs) and other mammalians that can benefit from the therapies disclosed herein. Exemplary human patients can be male and/or female.

"Patient in need thereof" or "subject in need thereof" is referred to herein as a patient diagnosed with, at risk or having, predetermined to have, or suspected of having a disease or disorder (e.g., T- or NK-cell malignancy).

The terms "pathogenic mutation," "pathogenic variant," "disease casing mutation," "disease causing variant," "deleterious mutation," or "predisposing mutation" refers to a genetic alteration or mutation that increases an individual's susceptibility or predisposition to a certain disease or disorder. In some embodiments, the pathogenic mutation comprises at least one wild-type amino acid substituted by at least one pathogenic amino acid in a protein encoded by a gene.

The term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g. the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). The terms such as "excipient," "carrier," "pharmaceutically acceptable carrier," "vehicle," or the like are used interchangeably herein.

The term "pharmaceutical composition" means a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

By "Programmed cell death 1 (PDCD1 or PD-1) polypeptide" is meant a protein having at least about 85% amino acid sequence identity to NCBI Accession No. AJS10360.1 or a fragment thereof. The PD-1 protein is thought to be involved in T cell function regulation during immune reactions and in tolerance conditions. An exemplary B2M polypeptide sequence is provided below. IDC-66 DNA

```
>AJS10360.1 programmed cell death 1 protein
[Homo sapiens]
MQIPQAPWPVVWAVLQLGWRPGWFLDSPDRPWNPPTFSPALLVVTEGDNA

TFTCSFSNTSESFVLNWYRMSPSNQTDKLAAFPEDRSQPGQDCRFRVTQL

PNGRDFHMSVVRARRNDSGTYLCGAISLAPKAQIKESLRAELRVTERRAE

VPTAHPSPSPRPAGQFQTLVVGVVGGLLGSLVLLVWVLAVICSRAARGTI

GARRTGQPLKEDPSAVPVFSVDYGELDFQWREKTPEPPVPCVPEQTEYAT

IVFPSGMGTSSPARRGSADGPRSAQPLRPEDGHCSWPL
```

By "Programmed cell death 1 (PDCD1 or PD-1) polynucleotide" is meant a nucleic acid molecule encoding a PD-1 polypeptide. The PDCD1 gene encodes an inhibitory cell surface receptor that inhibits T-cell effector functions in an antigen-specific manner. An exemplary PDCD1 nucleic acid sequence is provided below.

```
>AY238517.1 Homo sapiens programmed cell death
1 (PDCD1) mRNA, complete cds
ATGCAGATCCCACAGGCGCCCTGGCCAGTCGTCTGGGCGGTGCTACAACT

GGGCTGGCGGCCAGGATGGTTCTTAGACTCCCCAGACAGGCCCTGGAACC

CCCCCACCTTCTCCCCAGCCCTGCTCGTGGTGACCGAAGGGGACAACCCC

ACCTTCACCTGCAGCTTCTCCAACACATCGGAGAGCTTCGTGCTAAACTG

GTACCGCATGAGCCCCAGCAACCAGACGGACAAGCTGGCCGCCTTCCCCG

AGGACCGCAGCCAGCCCGGCCAGGACTGCCGCTTCCGTGTCACACAACTG

CCCAACGGGCGTGACTTCCACATGAGCGTGGTCAGGGCCCGGCGCAATGA

CAGCGGCACCTACCTCTGTGGGGCCATCTCCCTGGCCCCCAAGGCGCAGA

TCAAAGAGAGCCTGCGGGCAGAGCTCAGGGTGACAGAGAGAAGGGCAGAA

GTGCCCACAGCCCACCCCAGCCCCTCACCCAGGCCAGCCGGCCAGTTCCA

AACCCTGGTGGTTGGTGTCGTGGGCGGCCTGCTGGGCAGCCTGGTGCTGC

TAGTCTGGGTCCTGGCCGTCATCTGCTCCCGGGCCGCACGAGGGACAATA

GGAGCCAGGCGCACCGGCCAGCCCCTGAAGGAGGACCCCTCAGCCGTGCC

TGTGTTCTCTGTGGACTATGGGGAGCTGGATTTCCAGTGGCGAGAGAAGA

CCCCGGAGCCCCCCGTGCCCTGTGTCCCTGAGCAGACGGAGTATGCCACC

ATTGTCTTTCCTAGCGGAATGGGCACCTCATCCCCCGCCCGCAGGGGCTC

AGCTGACGGCCCTCGGAGTGCCCAGCCACTGAGGCCTGAGGATGGACACT

GCTCTTGGCCCCTCTGA
```

The terms "protein," "peptide," "polypeptide," and their grammatical equivalents are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide can refer to an individual protein or a collection of proteins. One or more of the amino acids in a protein, peptide, or polypeptide can be modified, for example, by the addition of a chemical entity such as a carbohydrate group, a hydroxyl group, a phosphate group, a farnesyl group, an isofarnesyl group, a fatty acid group, a linker for conjugation, functionalization, or other modifications, etc. A protein, peptide, or polypeptide can also be a single molecule or can be a multi-molecular complex. A protein, peptide, or polypeptide can be just a fragment of a naturally occurring protein or peptide. A protein, peptide, or polypeptide can be naturally occurring, recombinant, or synthetic, or any combination thereof. The term "fusion protein" as used herein refers to a hybrid polypeptide which comprises protein domains from at least two different proteins. One protein can be located at the amino-terminal (N-terminal) portion of the fusion protein or at the carboxy-terminal (C-terminal) protein thus forming an amino-terminal fusion protein or a carboxy-terminal fusion protein, respectively. A protein can comprise different domains, for example, a nucleic acid binding domain (e.g., the gRNA binding domain of Cas9 that directs the binding of the protein to a target site) and a nucleic acid cleavage domain, or a catalytic domain of a nucleic acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA or DNA. Any of the proteins provided herein can be produced by any method known in the art. For example, the proteins provided herein can be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

Polypeptides and proteins disclosed herein (including functional portions and functional variants thereof) can comprise synthetic amino acids in place of one or more naturally-occurring amino acids. Such synthetic amino acids are known in the art, and include, for example, aminocyclohexane carboxylic acid, norleucine, $\alpha$-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, $\beta$-phenylserine $\beta$-hydroxyphenylalanine, phenylglycine, $\alpha$-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, $\alpha$-aminocyclopentane carboxylic acid, $\alpha$-aminocyclohexane carboxylic acid, $\alpha$-aminocycloheptane carboxylic acid, a-(2-amino-2-norbornane)-carboxylic acid, $\alpha,\gamma$-diaminobutyric acid, $\alpha,\beta$-diaminopropionic acid, homophenylalanine, and $\alpha$-tert-butylglycine. The polypeptides and proteins can be associated with post-translational modifications of one or more amino acids of the polypeptide constructs. Non-limiting examples of post-translational modifications include phosphorylation, acylation including acetylation and formylation, glycosylation (including N-linked and O-linked), amidation, hydroxylation, alkylation including methylation and ethylation, ubiquitylation, addition of pyrrolidone carboxylic acid, formation of disulfide bridges, sulfation, myristoylation, palmitoylation, isoprenylation, farnesylation, geranylation, glypiation, lipoylation and iodination.

By "promoter" is meant an array of nucleic acid control sequences, which direct transcription of a nucleic acid. A promoter includes necessary nucleic acid sequences near the start site of transcription. A promoter also optionally includes distal enhancer or repressor sequence elements. A "constitutive promoter" is a promoter that is continuously active and is not subject to regulation by external signals or molecules. In contrast, the activity of an "inducible promoter" is regulated by an external signal or molecule (for example, a transcription factor). By way of example, a promoter may be a CMV promoter.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, the reference is a wild-type or healthy cell. In other embodiments and without limitation, a reference is an untreated cell that is not subjected to a test condition, or is subjected to placebo or normal saline, medium, buffer, and/or a control vector that does not harbor a polynucleotide of interest.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, at least about 25 amino acids, about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, and about 100 nucleotides or about 300 nucleotides or any integer thereabout or therebetween. In some embodiments, a reference sequence is a wild-type sequence of a protein of interest. In other embodiments, a reference sequence is a polynucleotide sequence encoding a wild-type protein.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821(2012), the entire contents of which is incorporated herein by reference. Other examples of gRNAs (e.g., those including domain 2) can be found in U.S. Provisional Patent Application No.

61/874,682, filed Sep. 6, 2013, entitled "Switchable Cas9 Nucleases and Uses Thereof," and U.S. Provisional Patent Application, No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex.

In some embodiments, the RNA-programmable nuclease is the (CRISPR-associated system) Cas9 endonuclease, for example, Cas9 (Csnl) from *Streptococcus pyogenes* (see, e.g., "Complete genome sequence of an Ml strain of *Streptococcus pyogenes*." Ferretti J. J., et al., Proc. Natl. Acad. Sci. U.S.A. 98:4658-4663(2001); "CRISPR RNA maturation by trans-encoded small RNA and host factor RNase III." Deltcheva E., et al., Nature 471:602-607(2011).Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. Science 339, 819-823 (2013); Mali, P. et al., RNA-guided human genome engineering via Cas9. Science 339, 823-826 (2013); Hwang, W. Y. et al., Efficient genome editing in zebrafish using a CRISPR-Cas system. Nature biotechnology 31, 227-229 (2013); Jinek, M. et al., RNA-programmed genome editing in human cells. eLife 2, e00471 (2013); Dicarlo, J. E. et al., Genome engineering in *Saccharomyces cerevisiae* using CRISPR-Cas systems. Nucleic acids research (2013); Jiang, W. et al. RNA-guided editing of bacterial genomes using CRISPR-Cas systems. Nature biotechnology 31, 233-239 (2013); the entire contents of each of which are incorporated herein by reference).

By "signaling domain" is meant an intracellular portion of a protein expressed in a T cell that transduces a T cell effector function signal (e.g., an activation signal) and directs the T cell to perform a specialized function. T cell activation can be induced by a number of factors, including binding of cognate antigen to the T cell receptor on the surface of T cells and binding of cognate ligand to costimulatory molecules on the surface of the T cell. A T cell co-stimulatory molecule is a cognate binding partner on a T cell that specifically binds with a co-stimulatory ligand, thereby mediating a co-stimulatory response by the T cell, such as, but not limited to, proliferation. Co-stimulatory molecules include, but are not limited to an MHC class I molecule. In some embodiments, the co-stimulatory domain is a CD2 cytoplasmic domain. Activation of a T cell leads to immune response, Such as T cell proliferation and differentiation (see, e.g., Smith-Garvin et al., Annu. Rev. Immunol., 27:591-619, 2009). Exemplary T cell signaling domains are known in the art. Non-limiting examples include the CD2, CD3ζ, CD8, CD28, CD27, CD154, GITR (TNFRSF18), CD134 (OX40), and CD137 (4-1BB) signaling domains.

By "single-chain antibody" or "scFv" is meant a genetically engineered molecule containing the VH and VL domains of one or more antibodies linked by a suitable polypeptide linker as a genetically fused single chain molecule (see, e.g., Bird et al., Science, 242:423-426, 1988;

Huston et al., Proc. Natl. Acad. Sci., 85:5879-5883, 1988: Ahmad et al., Clin. Dev. Immunol., 2012, doi:10.1155/2012/980250: Marbry, IDrugs, 13:543-549, 2010). In some embodiments, the intramolecular orientation of the VH-domain and the VL-domain in an scFv is VH-domain-linker domain-VL-domain. In some embodiments, the intramolecular orientation of the VH-domain and the VL-domain in an scFv is VL-domain-linker domain-VH-domain.

The term "single nucleotide polymorphism (SNP)" is a variation in a single nucleotide that occurs at a specific position in the genome, where each variation is present to some appreciable degree within a population (e.g., >1%). For example, at a specific base position in the human genome, the C nucleotide can appear in most individuals, but in a minority of individuals, the position is occupied by an A. This means that there is a SNP at this specific position, and the two possible nucleotide variations, C or A, are said to be alleles for this position. SNPs underlie differences in susceptibility to disease. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs. Synonymous SNPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation (e.g., associated with cancer) can also be called a single-nucleotide alteration.

By "specifically binds" is meant a nucleic acid molecule, polypeptide, or complex thereof (e.g., a nucleic acid programmable DNA binding protein, a guide nucleic acid, and a chimeric antigen receptor), compound, or molecule that recognizes and binds a polypeptide and/or nucleic acid molecule of the invention, but which does not substantially recognize and bind other molecules in a sample, for example, a biological sample. For example, a chimeric antigen receptor specifically binds to a particular marker expressed on the surface of a cell, but does not bind to other polypeptides, carbohydrates, lipids, or any other compound on the surface of the cell.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 370 C, and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a one: embodiment, hybridization will occur at 30° C. in 750 mM NaCl, 75 mM trisodium citrate, and 1% SDS. In another embodiment, hybridization will occur at 37° C. in 500 mM NaCl, 50 mM trisodium citrate, 1% SDS, 35% formamide, and 100 μg/ml denatured salmon sperm DNA (ssDNA). In another embodiment, hybridization will occur at 42° C. in 250 mM NaCl, 25 mM trisodium citrate, 1% SDS, 50% formamide, and 200 μg/ml ssDNA. Useful variations on these conditions will be apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In a more preferred embodiment, wash steps will occur at 42° C. in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be apparent to those skilled in the art. Hybridization techniques are well known to those skilled in the art and are described, for example, in Benton and Davis (Science 196:180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "split" is meant divided into two or more fragments. A "split Cas9 protein" or "split Cas9" refers to a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a "reconstituted" Cas9 protein. In particular embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351: 867-871. PDB file: 5F9R, each of which is incorporated herein by reference. In some embodiments, the protein is divided into two fragments at any C, T, A, or S within a region of SpCas9 between about amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, S469, or C574. In some embodiments, the process of dividing the protein into two fragments is referred to as "splitting" the protein.

In other embodiments, the N-terminal portion of the Cas9 protein comprises amino acids 1-573 or 1-637 *S. pyogenes* Cas9 wild-type (SpCas9) (NCBI Reference Sequence: NC_002737.2, Uniprot Reference Sequence: Q99ZW2) and the C-terminal portion of the Cas9 protein comprises a portion of amino acids 574-1368 or 638-1368 of SpCas9 wild-type, or a corresponding position thereof.

The C-terminal portion of the split Cas9 can be joined with the N-terminal portion of the split Cas9 to form a complete Cas9 protein. In some embodiments, the C-terminal portion of the Cas9 protein starts from where the N-terminal portion of the Cas9 protein ends. As such, in some embodiments, the C-terminal portion of the split Cas9 comprises a portion of amino acids (551-651)-1368 of spCas9. "(551-651)-1368" means starting at an amino acid between amino acids 551-651 (inclusive) and ending at amino acid 1368. For example, the C-terminal portion of the split Cas9 may comprise a portion of any one of amino acid 551-1368, 552-1368, 553-1368, 554-1368, 555-1368, 556-1368, 557-1368, 558-1368, 559-1368, 560-1368, 561-1368, 562-1368, 563-1368, 564-1368, 565-1368, 566-1368, 567-1368, 568-1368, 569-1368, 570-1368, 571-1368, 572-1368, 573-1368, 574-1368, 575-1368, 576-1368, 577-1368, 578-1368, 579-1368, 580-1368, 581-1368, 582-1368, 583-1368, 584-1368, 585-1368, 586-1368, 587-1368, 588-1368, 589-1368, 590-1368, 591-1368, 592-1368, 593-1368, 594-1368, 595-1368, 596-1368, 597-1368, 598-1368, 599-1368, 600-1368, 601-1368, 602-1368, 603-1368, 604-1368, 605-1368, 606-1368, 607-1368, 608-1368, 609-1368, 610-1368, 611-1368, 612-1368, 613-1368, 614-1368, 615-1368, 616-1368, 617-1368, 618-1368, 619-1368, 620-1368, 621-1368, 622-1368, 623-1368, 624-1368, 625-1368, 626-1368, 627-1368, 628-1368, 629-1368, 630-1368, 631-1368, 632-1368, 633-1368, 634-1368, 635-1368, 636-1368, 637-1368, 638-1368, 639-1368, 640-1368, 641-1368, 642-1368, 643-1368, 644-1368, 645-1368, 646-1368, 647-1368, 648-1368, 649-1368, 650-1368, or 651-1368 of spCas9. In some embodiments, the C-terminal portion of the split Cas9 protein comprises a portion of amino acids 574-1368 or 638-1368 of SpCas9.

By "subject" is meant a mammal, including, but not limited to, a human or non-human mammal, such as a bovine, equine, canine, ovine, or feline. Subjects include livestock, domesticated animals raised to produce labor and to provide commodities, such as food, including without limitation, cattle, goats, chickens, horses, pigs, rabbits, and sheep.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). In one embodiment, such a sequence is at least 60%, 80% or 85%, 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, COBALT, EMBOSS Needle, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

COBALT is used, for example, with the following parameters:

a) alignment parameters: Gap penalties—11, −1 and End-Gap penalties—5, −1, b) CDD Parameters: Use RPS BLAST on; Blast E-value 0.003; Find Conserved columns and Recompute on, and c) Query Clustering Parameters: Use query clusters on; Word Size 4; Max cluster distance 0.8; Alphabet Regular.

EMBOSS Needle is used, for example, with the following parameters:

a) Matrix: BLOSUM62;

b) GAP OPEN: 10;

c) GAP EXTEND: 0.5;

d) OUTPUT FORMAT: pair;

e) END GAP PENALTY: false;

f) END GAP OPEN: 10; and g) END GAP EXTEND: 0.5.

The term "target site" refers to a sequence within a nucleic acid molecule that is modified by a nucleobase editor. In one embodiment, the target site is deaminated by a deaminase or a fusion protein comprising a deaminase (e.g., cytidine or adenine deaminase).

By "T Cell Receptor Alpha Constant (TRAC) polypeptide" is meant a protein having at least about 85% amino acid sequence identity to NCBI Accession No. P01848.2 or fragment thereof and having immunomodulatory activity. An exemplary amino acid sequence is provided below.

```
>sp|P01848.2|TRAC_HUMAN RecName: Full = T cell
receptor alpha constant
IQNPDPAVYQLRDSKSSDKSVCLETDFDSQTNVSQSKDSDVYITDKTVLD

MRSMDFKSNSAVAWSNKSDFACANAFNNSIIPEDTFFPSPESSCDVKLVE

KSFETDTNLNFQNLSVIGFRILLLKVAGFNLLMTLRLWSS
```

By "T Cell Receptor Alpha Constant (TRAC) polynucle-otide" is meant a nucleic acid encoding a TRAC polypeptide. Exemplary TRAC nucleic acid sequences are provided below.

```
UCSC human genome database. Gene ENSG00000277734.8 Human T-cell
receptor alpha chain (TCR-alpha)
catgctaatcctccggcaaacctctgtttcctcctcaaaaggcaggaggtcggaaagaataaac aatgagagtcacattaaaaacacaaaatcctacggaaatactgaagaatgagtctcagcactaa ggaaaagcctccagcagctcctgctttctgagggtgaaggatagacgctgtggctctgcatgac tcactagcactctatcacggccatattctggcagggtcagtggctccaactaacatttgtttgg tactttacagtttattaaatagatgtttatatggagaagctctcatttctttctcagaagagcc tggctaggaaggtggatgaggcaccatattcattttgcaggtgaaattcctgagatgtaaggag ctgctgtgacttgctcaaggccttatatcgagtaaacggtagtgctgggggcttagacgcaggtg ttctgatttatagttcaaaacctctatcaatgagagagcaatctcctggtaatgtgatagattt cccaacttaatgccaacataccataaacctcccattctgctaatgcccagcctaagttggggag accactccagattccaagatgtacagtttgctttgctgggccttttcccatgcctgcctttac tctgccagagttatattgctgggggttttgaagaagatcctattaaataaaagaataagcagtat tattaagtagccctgcatttcaggtttccttgagtggcaggccaggcctggccgtgaacgttca ctgaaatcatggcctcttggccaagattgatagcttgtgcctgtccctgagtcccagtccatca cgagcagctggtttctaagatgctatttcccgtataaagcatgagaccgtgacttgccagcccc acagagccccgcccttgtccatcactggcatctggactccagcctgggttggggcaaagaggga aatgagatcatgtcctaaccctgatcctcttgtcccacagATATCCAGAACCCTGACCCTGCCG

TGTACCAGCTGAGAGACTCTAAATCCAGTGACAAGTCTGTCTGCCTATTCACCGATTTTGATTC

TCAAACAAATGTGTCACAAAGTAAGGATTCTGATGTGTATATCACAGACAAAACTGTGCTAGAC

ATGAGGTCTATGGACTTCAAGAGCAACAGTGCTGTGGCCTGGAGCAACAAATCTGACTTTGCAT

GTGCAAAGGCCTTCAACAACAGCATTATTCCAGAAGACACCTTCTTCCCCAGCCCAGgtaaggg cagctttggtgccttcgcaggctgtttccttgcttcaggaatggccaggttctgcccagagctc tggtcaatgatgtctaaaactcctctgattggtggtctcggccttatccattgccaccaaaacc ctctttttactaagaaacagtgagccttgttctggcagtccagagaatgacacgggaaaaaagc agatgaagagaaggtggcaggagagggcacgtggcccagcctcagtctctccaactgagttcct gcctgcctgcctttgctcagactgtttgcccttactgctcttctaggcctcattctaagcccc ttctccaagttgcctctccttatttctccctgtctgccaaaaaatctttcccagctcactaagt cagtctcacgcagtcactcattaacccaccaatcactgattgtgccggcacatgaatgcaccag gtgttgaagtggaggaattaaaaagtcagatgaggggtgtgcccagaggaagcaccattctagt tgggggagcccatctgtcagctgggaaaagtccaaataacttcagattggaatgtgtttaact cagggttgagaaacagctaccttcaggacaaaagtcagggaagggctctctgaagaaatgcta cttgaagataccagccctaccaagggcagggagaggaccctatagaggcctgggacaggagctc aatgagaaaggagaagagcagcaggcatgagttgaatgaaggaggcagggccgggtcacagggc cttctaggccatgagagggtagacagtattctaaggacgccagaaagctgttgatcggcttcaa gcaggggagggacacctaatttgcttttcttttttttttttttttttttttttttttttgagat ggagttttgctcttgttgcccaggctggagtgcaatggtgcatcttggctcactgcaacctccg cctcccaggttcaagtgattctcctgcctcagcctcccgagtagctgagattacaggcacccgc caccatgcctggctaattttttgtattttttagtagagacagggtttcactatgttggccaggct ggtctcgaactcctgacctcaggtgatccacccgcttcagcctcccaaagtgctgggattacag
```

-continued

```
gcgtgagccaccacacccggcctgcttttcttaaagatcaatctgagtgctgtacggagagtgg gttgtaagccaagagtagaagcagaaagggagcagttgcagcagagagatgatggaggcctggg cagggtggtggcagggaggtaaccaacaccattcaggtttcaaaggtagaaccatgcagggatg agaaagcaaagaggggatcaaggaaggcagctggattttggcctgagcagctgagtcaatgata gtgccgtttactaagaagaaaccaaggaaaaaatttggggtgcagggatcaaaactttttggaa catatgaaagtacgtgtttatactctttatggcccttgtcactatgtatgcctcgctgcctcca ttggactctagaatgaagccaggcaagagcagggtctatgtgtgatggcacatgtggccagggt catgcaacatgtactttgtacaaacagtgtatattgagtaaatagaaatggtgtccaggagccg aggtatcggtcctgccagggccaggggctctccctagcaggtgctcatatgctgtaagttccct ccagatctctccacaaggaggcatggaaaggctgtagttgttcacctgcccaagaactaggagg tctggggtgggagagtcagcctgctctggatgctgaaagaatgtctgttttttccttttagAAAG TTCCTGTGATGTCAAGCTGGTCGAGAAAAGCTTTGAAACAGgtaagacaggggtctagcctggg tttgcacaggattgcggaagtgatgaacccgcaataaccctgcctggatgagggagtgggaaga aattagtagatgtgggaatgaatgatgaggaatggaaacagcggttcaagacctgcccagagct gggtggggtctctcctgaatccctctcaccatctctgactttccattctaagcactttgaggat gagtttctagcttcaatagaccaaggactctctcctaggcctctgtattcctttcaacagctcc actgtcaagagagccagagagagcttctgggtggcccagctgtgaaatttctgagtcccttagg gatagccctaaacgaaccagatcatcctgaggacagccaagaggttttgccttctttcaagaca agcaacagtactcacataggctgtgggcaatggtcctgtctctcaagaatcccctgccactcct cacacccaccctgggcccatattcatttccatttgagttgttcttattgagtcatccttcctgt ggtagcggaactcactaaggggcccatctggacccgaggtattgtgatgataaattctgagcac ctaccccatccccagaagggctcagaaataaaataagagccaagtctagtcggtgtttcctgtc ttgaaacacaatactgttggccctggaagaatgcacagaatctgtttgtaaggggatatgcaca gaagctgcaagggacaggaggtgcaggagctgcaggcctcccccacccagcctgctctgccttg gggaaaaccgtgggtgtgtcctgcaggccatgcaggcctgggacatgcaagcccataaccgctg tggcctcttggttttacagATACGAACCTAAACTTTCAAAACCTGTCAGTGATTGGGTTCCGAA TCCTCCTCCTGAAAGTGGCCGGGTTTAATCTGCTCATGACGCTGCGGCTGTGGTCCAGCTGAGg tgaggggccttgaagctgggagtggggtttagggacgcgggtctctgggtgcatcctaagctct gagagcaaacctccctgcagggtcttgcttttaagtccaaagcctgagcccaccaaactctcct acttcttcctgttacaaattcctcttgtgcaataataatggcctgaaacgctgtaaaatatcct catttcagccgcctcagttgcacttctcccctatgaggtaggaagaacagttgtttagaaacga agaaactgaggccccacagctaatgagtggaggaagagagacacttgtgtacaccacatgcctt gtgttgtacttctctcaccgtgtaacctcctcatgtcctctctccccagtacggctctcttagc tcagtagaaagaagacattacactcatattacaccccaatcctggctagagtctccgcaccctc ctcccccagggtccccagtcgtcttgctgacaactgcatcctgttccatcaccatcaaaaaaaa actccaggctgggtgcgggggctcacacctgtaatcccagcactttgggaggcagaggcaggag gagcacaggagctggagaccagcctgggcaacacagggagaccccgcctctacaaaaagtgaaa aaattaaccaggtgtggtgctgcacacctgtagtcccagctacttaagaggctgagatgggagg atcgcttgagccctggaatgttgaggctacaatgagctgtgattgcgtcactgcactccagcct ggaagacaaagcaagatcctgtctcaaataataaaaaaaataagaactccagggtacatttgct cctagaactctaccacatagccccaaacagagccatcaccatcacatccctaacagtcctgggt
```

-continued cttcctcagtgtccagcctgacttctgttcttcctcattccagATCTGCAAGATTGTAAGACAG

CCTGTGCTCCCTCGCTCCTTCCTCTGCATTGCCCCTCTTCTCCCTCTCCAAACAGAGGGAACTC

TCCTACCCCCAAGGAGGTGAAAGCTGCTACCACCTCTGTGCCCCCCCGGCAATGCCACCAACTG

GATCCTACCCGAATTTATGATTAAGATTGCTGAAGAGCTGCCAAACACTGCTGCCACCCCCTCT

GTTCCCTTATTGCTGCTTGTCACTGCCTGACATTCACGGCAGAGGCAAGGCTGCTGCAGCCTCC

CCTGGCTGTGCACATTCCCTCCTGCTCCCCAGAGACTGCCTCCGCCATCCCACAGATGATGGAT

CTTCAGTGGGTTCTCTTGGGCTCTAGGTCCTGCAGAATGTTGTGAGGGGTTTATTTTTTTTTAA

TAGTGTTCATAAAGAAATACATAGTATTCTTCTTCTCAAGACGTGGGGGGAAATTATCTCATTA

TCGAGGCCCTGCTATGCTGTGTATCTGGGCGTGTTGTATGTCCTGCTGCCGATGCCTTCATTAA

AATGATTTGGAAGAGCAGA

Nucleotides in lower cases above are untranslated regions or introns, and nucleotides in upper cases are exons.

>X02592.1 Human mRNA for T-cell receptor alpha chain (TCR-alpha)
TTTTGAAACCCTTCAAAGGCAGAGACTTGTCCAGCCTAACCTGCCTGCTG

CTCCTAGCTCCTGAGGCTCAGGGCCCTTGGCTTCTGTCCGCTCTGCTCAG

GGCCCTCCAGCGTGGCCACTGCTCAGCCATGCTCCTGCTGCTCGTCCCAG

TGCTCGAGGTGATTTTTACCCTGGGAGGAACCAGAGCCCAGTCGGTGACC

CAGCTTGGCAGCCACGTCTCTGTCTCTGAAGGAGCCCTGGTTCTGCTGAG

GTGCAACTACTCATCGTCTGTTCCACCATATCTCTTCTGGTATGTGCAAT

ACCCCAACCAAGGACTCCAGCTTCTCCTGAAGTACACATCAGCGGCCACC

CTGGTTAAAGGCATCAACGGTTTTGAGGCTGAATTTAAGAAGAGTGAAAC

CTCCTTCCACCTGACGAAACCCTCAGCCCATATGAGCGACGCGGCTGAGT

ACTTCTGTGCTGTGAGTGATCTCGAACCGAACAGCAGTGCTTCCAAGATA

ATCTTTGGATCAGGGACCAGACTCAGCATCCGGCCAAATATCCAGAACCC

TGACCCTGCCGTGTACCAGCTGAGAGACTCTAAATCCAGTGACAAGTCTG

TCTGCCTATTCACCGATTTTGATTCTCAAACAAATGTGTCACAAAGTAAG

GATTCTGATGTGTATATCACAGACAAAACTGTGCTAGACATGAGGTCTAT

GGACTTCAAGAGCAACAGTGCTGTGGCCTGGAGCAACAAATCTGACTTTG

CATGTGCAAACGCCTTCAACAACAGCATTATTCCAGAAGACACCTTCTTC

CCCAGCCCAGAAAGTTCCTGTGATGTCAAGCTGGTCGAGAAAAGCTTTGA

AACAGATACGAACCTAAACTTTCAAAACCTGTCAGTGATTGGGTTCCGAA

TCCTCCTCCTGAAAGTGGCCGGGTTTAATCTGCTCATGACGCTGCGGCTG

TGGTCCAGCTGAGATCTGCAAGATTGTAAGACAGCCTGTGCTCCCTCGCT

CCTTCCTCTGCATTGCCCCTCTTCTCCCTCTCCAAACAGAGGGAACTCTC

CTACCCCCAAGGAGGTGAAAGCTGCTACCACCTCTGTGCCCCCCCGGTAA

TGCCACCAACTGGATCCTACCCGAATTTATGATTAAGATTGCTGAAGAGC

TGCCAAACACTGCTGCCACCCCCTCTGTTCCCTTATTGCTGCTTGTCACT

GCCTGACATTCACGGCAGAGGCAAGGCTGCTGCAGCCTCCCCTGGCTGTG

CACATTCCCTCCTGCTCCCCAGAGACTGCCTCCGCCATCCCACAGATGAC

-continued

GGATCTTCAGTGGGTTCTCTTGGGCTCTAGGTCCTGGAGAATGTTGTGAG

GGGTTTATTTTTTTTTAATAGTGTTCATAAAGAAATACATAGTATTCTTC

TTCTCAAGACGTGGGGGGAAATTATCTCATTATCGAGGCCCTGCTATGCT

GTGTGTCTGGGCGTGTTGTATGTCCTGCTGCCGATGCCTTCATTAAAATG

ATTTGGAA

By "T cell receptor beta constant 1 polypeptide (TRBC1)" is meant a protein having at least about 85% amino acid sequence identity to NCBI Accession No. P01850 or fragment thereof and having immunomodulatory activity. An exemplary amino acid sequence is provided below.

>sp|P01850|TRBC1_HUMAN T cell receptor beta constant 1 OS = Homo sapiens OX = 9606
GN = RBC1 PE = 1 SV = 4
DLNKVFPPEVAVFEPSEAEISHTQKATLVCLATGFFPDHVELSWWVNGKE

VHSGVSTDPQPLKEQPALNDSRYCLSSRLRVSATFWQNPRNHFRCQVQFY

GLSENDEWTQDRAKPVTQIVSAEAWGRADCGFTSVSYQQGVLSATILYEI

LLGKATLYAVLVSALVLMAMVKRKDF

By "T cell receptor beta constant 1 polynucleotide (TRBC1)" is meant a nucleic acid encoding a TRBC1 polypeptide. An exemplary TRBC1 nucleic acid sequence is provided below.

>X00437.1
CTGGTCTAGAATATTCCACATCTGCTCTCACTCTGCCATGGACTCCTGGA

CCTTCTGCTGTGTGTCCCTTTGCATCCTGGTAGCGAAGCATACAGATGCT

GGAGTTATCCAGTCACCCCGCCATGAGGTGACAGAGATGGGACAAGAAGT

GACTCTGAGATGTAAACCAATTTCAGGCCACAACTCCCTTTTCTGGTACA

GACAGACCATGATGCGGGGACTGGAGTTGCTCATTTACTTTAACAACAAC

GTTCCGATAGATGATTCAGGGATGCCCGAGGATCGATTCTCAGCTAAGAT

GCCTAATGCATCATTCTCCACTCTGAAGATCCAGCCCTCAGAACCCAGGG

ACTCAGCTGTGTACTTCTGTGCCAGCAGTTTCTCGACCTGTTCGGCTAAC

TATGGCTACACCTTCGGTTCGGGGACCAGGTTAACCGTTGTAGAGGACCT

GAACAAGGTGTTCCCACCCGAGGTCGCTGTGTTTGAGCCATCAGAAGCAG

-continued

```
AGATCTCCCACACCCAAAAGGCCACACTGGTGTGCCTGGCCACAGGCTTC

TTCCCCGACCACGTGGAGCTGAGCTGGTGGGTGAATGGGAAGGAGGTGCA

CAGTGGGGTCAGCACAGACCCGCAGCCCCTCAAGGAGCAGCCCGCCCTCA

ATGACTCCAGATACTGCCTGAGCAGCCGCCTGAGGGTCTCGGCCACCTTC

TGGCAGAACCCCCGCAACCACTTCCGCTGTCAAGTCCAGTTCTACGGGCT

CTCGGAGAATGACGAGTGGACCCAGGATAGGGCCAAACCCGTCACCCAGA

TCGTCAGCGCCGAGGCCTGGGGTAGAGCAGACTGTGGCTTTACCTCGGTG

TCCTACCAGCAAGGGGTCCTGTCTGCCACCATCCTCTATGAGATCCTGCT

AGGGAAGGCCACCCTGTATGCTGTGCTGGTCAGCGCCCTTGTGTTGATGG

CCATGGTCAAGAGAAAGGATTTCTGAAGGCAGCCCTGGAAGTGGAGTTAG

GAGCTTCTAACCCGTCATGGTTCAATACACATTCTTCTTTTGCCAGCGCT

TCTGAAGAGCTGCTCTCACCTCTCTGCATCCCAATAGATATCCCCCTATG

TGCATGCACACCTGCACACTCACGGCTGAAATCTCCCTAACCCAGGGGGA

C
```

By "T cell receptor beta constant 2 polypeptide (TRBC2)" is meant a protein having at least about 85% amino acid sequence identity to NCBI Accession No. AOA5B9 or fragment thereof and having immunomodulatory activity. An exemplary amino acid sequence is provided below.

```
>sp|A0A5B9|TRBC2_HUMAN T cell receptor beta
constant 2 OS = Homo sapiens OX = 9606
GN = TRBC2 PE = 1 SV = 2
DLKNVFPPKVAVFEPSEAEISHTQKATLVCLATGFYPDHVELSWWVNGKE

VHSGVSTDPQPLKEQPALNDSRYCLSSRLRVSATFWQNPRNHFRCQVQFY

GLSENDEWTQDRAKPVTQIVSAEAWGRADCGFTSESYQQGVLSATILYEI

LLGKATLYAVLVSALVLMAMVKRKDSRG
```

By "T cell receptor beta constant 2 polynucleotide (TRBC2)" is meant a nucleic acid encoding a TRAC polypeptide. An exemplary TRBC2 nucleic acid sequence is provided below.

```
>NG_001333.2:655095-656583 Homo sapiens T cell
receptor beta locus (TRB) on chromosome7
AGGACCTGAAAAACGTGTTCCCACCCGAGGTCGCTGTGTTTGAGCCATCA

GAAGCAGAGATCTCCCACACCCAAAAGGCCACACTGGTATGCCTGGCCAC

AGGCTTCTACCCCGACCACGTGGAGCTGAGCTGGTGGGTGAATGGGAAGG

AGGTGCACAGTGGGGTCAGCACAGACCCGCAGCCCCTCAAGGAGCAGCCC

GCCCTCAATGACTCCAGATACTGCCTGAGCAGCCGCCTGAGGGTCTCGGC

CACCTTCTGGCAGAACCCCCGCAACCACTTCCGCTGTCAAGTCCAGTTCT

ACGGGCTCTCGGAGAATGACGAGTGGACCCAGGATAGGGCCAAACCCGTC

ACCCAGATCGTCAGCGCCGAGGCCTGGGGTAGAGCAGGTGAGTGGGGCCT

GGGGAGATGCCTGGAGGAGATTAGGTGAGACCAGCTACCAGGGAAAATGG

AAAGATCCAGGTAGCGGACAAGACTAGATCCAGAAGAAAGCCAGAGTGGA

CAAGGTGGGATGATCAAGGTTCACAGGGTCAGCAAAGCACGGTGTGCACT

TCCCCCACCAAGAAGCATAGAGGCTGAATGGAGCACCTCAAGCTCATTCT
```

-continued

```
TCCTTCAGATCCTGACACCTTAGAGCTAAGCTTTCAAGTCTCCCTGAGGA

CCAGCCATACAGCTCAGCATCTGAGTGGTGTGCATCCCATTCTCTTCTGG

GGTCCTGGTTTCCTAAGATCATAGTGACCACTTCGCTGGCACTGGAGCAG

CATGAGGGAGACAGAACCAGGGCTATCAAAGGAGGCTGACTTTGTACTAT

CTGATATGCATGTGTTTGTGGCCTGTGAGTCTGTGATGTAAGGCTCAATG

TCCTTACAAAGCAGCATTCTCTCATCCATTTTTCTTCCCCTGTTTTCTTT

CAGACTGTGGCTTCACCTCCGGTAAGTGAGTCTCTCCTTTTTCTCTCTAT

CTTTCGCCGTCTCTGCTCTCGAACCAGGGCATGGAGAATCCACGGACACA

GGGGCGTGAGGGAGGCCAGAGCCACCTGTGCACAGGTGCCTACATGCTCT

GTTCTTGTCAACAGAGTCTTACCAGCAAGGGGTCCTGTCTGCCACCATCC

TCTATGAGATCTTGCTAGGGAAGGCCACCTTGTATGCCGTGCTGGTCAGT

GCCCTCGTGCTGATGGCCATGGTAAGGAGGAGGGTGGGATAGGGCAGATG

ATGGGGGCAGGGGATGGAACATCACACATGGGCATAAAGGAATCTCAGAG

CCAGAGCACAGCCTAATATATCCTATCACCTCAATGAAACCATAATGAAG

CCAGACTGGGGAGAAAATGCAGGGAATATCACAGAATGCATCATGGGAGG

ATGGAGACAACCAGCGAGCCCTACTCAAATTAGGCCTCAGAGCCCGCCTC

CCCTGCCCTACTCCTGCTGTGCCATAGCCCCTGAAACCCTCAAAATGTTC

TCTCTTCCACAGGTCAAGAGAAAGGATTCCAGAGGCTAG
```

By "tet methylcytosine dioxygenase 2 (TET2) polypeptide" is meant a protein having at least about 85% amino acid sequence identity to NCBI Accession No. FM992369.1 or a fragment thereof and having catalytic activity to convert methylcytosine to 5-hydroxymethylcytosine. Defects in the gene have been associated with myeloproliferative disorders, and the enzyme's ability to methylate cytosine contributes to transcriptional regulation. An exemplary TET2 amino acid sequence is provided below.

```
>CAX30492.1 tet oncogene family member 2
[Homo sapiens]
MEQDRTNHVEGNRLSPFLIPSPPICQTEPLATKLQNGSPLPERAHPEVNG

DTKWHSFKSYYGIPCMKGSQNSRVSPDFTQESRGYSKCLQNGGIKRTVSE

PSLSGLLQIKKLKQDQKANGERRNFGVSQERNPGESSQPNVSDLSDKKES

VSSVAQENAVKDFTSFSTHNCSGPENPELQILNEQEGKSANYHDKNIVLL

KNKAVLMPNGATVSASSVEHTHGELLEKTLSQYYPDCVSIAVQKTTSHIN

AINSQATNELSCEITHPSHTSGQINSAQTSNSELPPKPAAVVSEACDADD

ADNASKLAAMLNTCSFQKPEQLQQQKSVFEICPSPAENNIQGTTKLASGE

EFCSGSSSNLQAPGGSSERYLKQNEMNGAYFKQSSVFTKDSFSATTTPPP

PSQLLLSPPPPLPQVPQLPSEGKSTLNGGVLEEHHHYPNQSNTTLLREVK

IEGKPEAPPSQSPNPSTHVCSPSPMLSERPQNNCVNRNDIQTAGTMTVPL

CSEKTRPMSEHLKHNPPIFGSSGELQDNCQQLMRNKEQEILKGRDKEQTR

DLVPPTQHYLKPGWIELKAPRFHQAESHLKRNEASLPSILQYQPNLSNQM

TSKQYTGNSNMPGGLPRQAYTQKTTQLEHKSQMYQVEMNQGQSQGTVDQH

LQFQKPSHQVHFSKTDHLPKAHVQSLCGTRFHFQQRADSQTEKLMSPVLK

QHLNQQASETEPFSNSHLLQHKPHKQAAQTQPSQSSHLPQNQQQQQKLQI
```

-continued

```
KNKEEILQTFPHPQSNNDQQREGSFFGQTKVEECFHGENQYSKSSEFETH

NVQMGLEEVQNINRRNSPYSQTMKSSACKIQVSCSNNTHLVSENKEQTTH

PELFAGNKTQNLHHMQYFPNNVIPKQDLLHRCFQEQEQKSQQASVIQGYK

NRNQDMSGQQAAQLAQQRYLIHNHANVFPVPDQGGSHTQTPPQKDTQKHA

ALRWHLLQKQEQQQTQQPQTESCHSQMHRPIKVEPGCKPHACMHTAPPEN

KTWKKVTKQENPPASCDNVQQKSIIETMEQHLKQFHAKSLFDHKALTLKS

QKQVKVEMSGPVTVLTRQTTAAELDSHTPALEQQTTSSEKTPTKRTAASV

LNNFIESPSKLLDTPIKNLLDTPVKTQYDFPSCRCVEQIIEKDEGPFYTH

LGAGPNVAAIREIMEERFGQKGKAIRIERVIYTGKEGKSSQGCPIAKWVV

RRSSSEEKLLCLVRERAGHTCEAAVIVILILVWEGIPLSLADKLYSELTE

TLRKYGTLTNRRCALNEERTCACQGLDPETCGASFSFGCSWSMYYNGCKF

ARSKIPRKFKLLGDDPKEEEKLESHLQNLSTLMAPTYKKLAPDAYNNQIE

YEHRAPECRLGLKEGRPFSGVTACLDFCAHAHRDLHNMQNGSTLVCTLTR

EDNREFGGKPEDEQLHVLPLYKVSDVDEFGSVEAQEEKKRSGAIQVLSSF

RRKVRMLAEPVKTCRQRKLEAKKAAAEKLSSLENSSNKNEKEKSAPSRTK
```

-continued

```
QTENASQAKQLAELLRLSGPVMQQSQQPQPLQKQPPQPQQQQRPQQQQPH

HPQTESVNSYSASGSTNPYMRRPNPVSPYPNSSHTSDIYGSTSPMNFYST

SSQAAGSYLNSSNPMNPYPGLLNQNTQYPSYQCNGNLSVDNCSPYLGSYS

PQSQPMDLYRYPSQDPLSKLSLPPIHTLYQPRFGNSQSFTSKYLGYGNQN

MQGDGFSSCTIRPNVHHVGKLPPYPTHEMDGHFMGATSRLPPNLSNPNMD

YKNGEHHSPSHIIHNYSAAPGMFNSSLHALHLQNKENDMLSHTANGLSKM

LPALNHDRTACVQGGLHKLSDANGQEKQPLALVQGVASGAEDNDEVWSDS

EQSFLDPDIGGVAVAPTHGSILIECAKRELHATTPLKNPNRNHPTRISLV

FYQHKSMNEPKHGLALWEAKMAEKAREKEEECEKYGPDYVPQKSHGKKVK

REPAEPHETSEPTYLRFIKSLAERTMSVTTDSTVTTSPYAFTRVTGPYNR

YI
```

By "tet methylcytosine dioxygenase 2 (TET2) polynucle-otide" is meant a nucleic acid molecule encoding a TET2 polypeptide. The TETs polypeptide encodes a methylcyto-sine dioxygenase and has transcription regulatory activity. An exemplary TET2 nucleic acid is presented below.

```
>FM992369.1 Homo sapiens mRNA for tet oncogene family
member 2 (TET2 gene)
CCGTGCCATCCCAACCTCCCACCTCGCCCCCAACCTTCGCGCTTGCTCTGCTTCTTCTCCCAGG

GGTGGAGACCCGCCGAGGTCCCCGGGGTTCCCGAGGGCTGCACCCTTCCCCGCGCTCGCCAGCC

CTGGCCCCTACTCCGCGCTGGTCCGGGCGCACCACTCCCCCCGCGCCACTGCACGGCGTGAGGG

CAGCCCAGGTCTCCACTGCGCGCCCCGCTGTACGGCCCCAGGTGCCGCCGGCCTTTGTGCTGGA

CGCCCGGTGCGGGGGGCTAATTCCCTGGGAGCCGGGGCTGAGGGCCCCAGGGCGGCGGCGCAGG

CCGGGGCGGAGCGGGAGGAGGCCGGGGCGGAGCAGGAGGAGGCCCGGGCGGAGGAGGAGAGCCG

GCGGTAGCGGCAGTGGCAGCGGCGAGAGCTTGGGCGGCCGCCGCCGCCTCCTCGCGAGCGCCGC

GCGCCCGGGTCCCGCTCGCATGCAAGTCACGTCCGCCCCCTCGGCGCGGCCGCCCCGAGACGCC

GGCCCCGCTGAGTGATGAGAACAGACGTCAAACTGCCTTATGAATATTGATGCGGAGGCTAGGC

TGCTTTCGTAGAGAAGCAGAAGGAAGCAAGATGGCTGCCCTTTAGGATTTGTTAGAAAGGAGAC

CCGACTGCAACTGCTGGATTGCTGCAAGGCTGAGGGACGAGAACGAGGCTGGCAAACATTCAGC

AGCACACCCTCTCAAGATTGTTTACTTGCCTTTGCTCCTGTTGAGTTACAACGCTTGGAAGCAG

GAGATGGGCTCAGCAGCAGCCAATAGGACATGATCCAGGAAGAGCAAATTCAACTAGAGGGCAG

CCTTGTGGATGGCCCCGAAGCAAGCCTGATGGAACAGGATAGAACCAACCATGTTGAGGGCAAC

AGACTAAGTCCATTCCTGATACCATCACCTCCCATTTGCCAGACAGAACCTCTGGCTACAAAGC

TCCAGAATGGAAGCCCACTGCCTGAGAGAGCTCATCCAGAAGTAAATGGAGACACCAAGTGGCA

CTCTTTCAAAAGTTATTATGGAATACCCTGTATGAAGGGAAGCCAGAATAGTCGTGTGAGTCCT

GACTTTACACAAGAAAGTAGAGGGTATTCCAAGTGTTTGCAAAATGGAGGAATAAAACGCACAG

TTAGTGAACCTTCTCTCTCTGGGCTCCTTCAGATCAAGAAATTGAAACAAGACCAAAAGGCTAA

TGGAGAAAGACGTAACTTCGGGGTAAGCCAAGAAAGAAATCCAGGTGAAAGCAGTCAACCAAAT

GTCTCCGATTTGAGTGATAAGAAAGAATCTGTGAGTTCTGTAGCCCAAGAAAATGCAGTTAAAG

ATTTCACCAGTTTTTCAACACATAACTGCAGTGGGCCTGAAAATCCAGAGCTTCAGATTCTGAA

TGAGCAGGAGGGGAAAAGTGCTAATTACCATGACAAGAACATTGTATTACTTAAAAACAAGGCA
```

-continued

GTGCTAATGCCTAATGGTGCTACAGTTTCTGCCTCTTCCGTGGAACACACACATGGTGAACTCC

TGGAAAAAACACTGTCTCAATATTATCCAGATTGTGTTTCCATTGCGGTGCAGAAAACCACATC

TCACATAAATGCCATTAACAGTCAGGCTACTAATGAGTTGTCCTGTGAGATCACTCACCCATCG

CATACCTCAGGGCAGATCAATTCCGCACAGACCTCTAACTCTGAGCTGCCTCCAAAGCCAGCTG

CAGTGGTGAGTGAGGCCTGTGATGCTGATGATGCTGATAATGCCAGTAAACTAGCTGCAATGCT

AAATACCTGTTCCTTTCAGAAACCAGAACAACTACAACAACAAAAATCAGTTTTTGAGATATGC

CCATCTCCTGCAGAAAATAACATCCAGGGAACCACAAAGCTAGCGTCTGGTGAAGAATTCTGTT

CAGGTTCCAGCAGCAATTTGCAAGCTCCTGGTGGCAGCTCTGAACGGTATTTAAAACAAAATGA

AATGAATGGTGCTTACTTCAAGCAAAGCTCAGTGTTCACTAAGGATTCCTTTTCTGCCACTACC

ACACCACCACCACCATCACAATTGCTTCTTTCTCCCCCTCCTCCTCTTCCACAGGTTCCTCAGC

TTCCTTCAGAAGGAAAAAGCACTCTGAATGGTGGAGTTTTAGAAGAACACCACCACTACCCCAA

CCAAAGTAACACAACACTTTTAAGGGAAGTGAAAATAGAGGGTAAACCTGAGGCACCACCTTCC

CAGAGTCCTAATCCATCTACACATGTATGCAGCCCTTCTCCGATGCTTTCTGAAAGGCCTCAGA

ATAATTGTGTGAACAGGAATGACATACAGACTGCAGGGACAATGACTGTTCCATTGTGTTCTGA

GAAAACAAGACCAATGTCAGAACACCTCAAGCATAACCCACCAATTTTTGGTAGCAGTGGAGAG

CTACAGGACAACTGCCAGCAGTTGATGAGAAACAAAGAGCAAGAGATTCTGAAGGGTCGAGACA

AGGAGCAAACACGAGATCTTGTGCCCCCAACACAGCACTATCTGAAACCAGGATGGATTGAATT

GAAGGCCCCTCGTTTTCACCAAGCGGAATCCCATCTAAAACGTAATGAGGCATCACTGCCATCA

ATTCTTCAGTATCAACCCAATCTCTCCAATCAAATGACCTCCAAACAATACACTGGAAATTCCA

ACATGCCTGGGGGGCTCCCAAGGCAAGCTTACACCCAGAAAACAACACAGCTGGAGCACAAGTC

ACAAATGTACCAAGTTGAAATGAATCAAGGGCAGTCCCAAGGTACAGTGGACCAACATCTCCAG

TTCCAAAAACCCTCACACCAGGTGCACTTCTCCAAAACAGACCATTTACCAAAAGCTCATGTGC

AGTCACTGTGTGGCACTAGATTTCATTTTCAACAAAGAGCAGATTCCCAAACTGAAAAACTTAT

GTCCCCAGTGTTGAAACAGCACTTGAATCAACAGGCTTCAGAGACTGAGCCATTTTCAAACTCA

CACCTTTTGCAACATAAGCCTCATAAACAGGCAGCACAAACACAACCATCCCAGAGTTCACATC

TCCCTCAAAACCAGCAACAGCAGCAAAAATTACAAATAAAGAATAAAGAGGAAATACTCCAGAC

TTTTCCTCACCCCCAAAGCAACAATGATCAGCAAAGAGAAGGATCATTCTTTGGCCAGACTAAA

GTGGAAGAATGTTTTCATGGTGAAAATCAGTATTCAAAATCAAGCGAGTTCGAGACTCATAATG

TCCAAATGGGACTGGAGGAAGTACAGAATATAAATCGTAGAAATTCCCCTTATAGTCAGACCAT

GAAATCAAGTGCATGCAAAATACAGGTTTCTTGTTCAAACAATACACACCTAGTTTCAGAGAAT

AAAGAACAGACTACACATCCTGAACTTTTTGCAGGAAACAAGACCCAAAACTTGCATCACATGC

AATATTTTCCAAATAATGTGATCCCAAAGCAAGATCTTCTTCACAGGTGCTTTCAAGAACAGGA

GCAGAAGTCACAACAAGCTTCAGTTCTACAGGGATATAAAAATAGAAACCAAGATATGTCTGGT

CAACAAGCTGCGCAACTTGCTCAGCAAAGGTACTTGATACATAACCATGCAAATGTTTTTCCTG

TGCCTGACCAGGGAGGAAGTCACACTCAGACCCCTCCCCAGAAGGACACTCAAAAGCATGCTGC

TCTAAGGTGGCATCTCTTACAGAAGCAAGAACAGCAGCAAACACAGCAACCCCAAACTGAGTCT

TGCCATAGTCAGATGCACAGGCCAATTAAGGTGGAACCTGGATGCAAGCCACATGCCTGTATGC

ACACAGCACCACCAGAAAACAAAACATGGAAAAAGGTAACTAAGCAAGAGAATCCACCTGCAAG

CTGTGATAATGTGCAGCAAAAGAGCATCATTGAGACCATGGAGCAGCATCTGAAGCAGTTTCAC

GCCAAGTCGTTATTTGACCATAAGGCTCTTACTCTCAAATCACGAAGCAAGTAAAAGTTGAAA

TGTCAGGGCCAGTCACAGTTTTGACTAGACAAACCACTGCTGCAGAACTTGATAGCCACACCCC

-continued

```
AGCTTTAGAGCAGCAAACAACTTCTTCAGAAAAGACACCAACCAAAAGAACAGCTGCTTCTGTT

CTCAATAATTTTATAGAGTCACCTTCCAAATTACTAGATACTCCTATAAAAAATTTATTGGATA

CACCTGTCAAGACTCAATATGATTTCCCATCTTGCAGATGTGTAGAGCAAATTATTGAAAAAGA

TGAAGGTCCTTTTTATACCCATCTAGGAGCAGGTCCTAATGTGGCAGCTATTAGAGAAATCATG

GAAGAAAGGTTTGGACAGAAGGGTAAAGCTATTAGGATTGAAAGAGTCATCTATACTGGTAAAG

AAGGCAAAAGTTCTCAGGGATGTCCTATTGCTAAGTGGGTGGTTCGCAGAAGCAGCAGTGAAGA

GAAGCTACTGTGTTTGGTGCGGGAGCGAGCTGGCCACACCTGTGAGGCTGCAGTGATTGTGATT

CTCATCCTGGTGTGGGAAGGAATCCCGCTGTCTCTGGCTGACAAACTCTACTCGGAGCTTACCG

AGACGCTGAGGAAATACGGCACGCTCACCAATCGCCGGTGTGCCTTGAATGAAGAGAGAACTTG

CGCCTGTCAGGGGCTGGATCCAGAAACCTGTGGTGCCTCCTTCTCTTTTGGTTGTTCATGGAGC

ATGTACTACAATGGATGTAAGTTTGCCAGAAGCAAGATCCCAAGGAAGTTTAAGCTGCTTGGGG

ATGACCCAAAAGAGGAAGAGAAACTGGAGTCTCATTTGCAAAACCTGTCCACTCTTATGGCACC

AACATATAAGAAACTTGCACCTGATGCATATAATAATCAGATTGAATATGAACACAGAGCACCA

GAGTGCCGTCTGGGTCTGAAGGAAGGCCGTCCATTCTCAGGGGTCACTGCATGTTTGGACTTCT

GTGCTCATGCCCACAGAGACTTGCACAACATGCAGAATGGCAGCACATTGGTATGCACTCTCAC

TAGAGAAGACAATCGAGAATTTGGAGGAAAACCTGAGGATGAGCAGCTTCACGTTCTGCCTTTA

TACAAAGTCTCTGACGTGGATGAGTTTGGGAGTGTGGAAGCTCAGGAGGAGAAAAAACGGAGTG

GTGCCATTCAGGTACTGAGTTCTTTTCGGCGAAAAGTCAGGATGTTAGCAGAGCCAGTCAAGAC

TTGCCGACAAAGGAAACTAGAAGCCAAGAAAGCTGCAGCTGAAAAGCTTTCCTCCCTGGAGAAC

AGCTCAAATAAAAATGAAAAGGAAAAGTCAGCCCCATCACGTACAAAACAAACTGAAAACGCAA

GCCAGGCTAAACAGTTGGCAGAACTTTTGCGACTTTCAGGACCAGTCATGCAGCAGTCCCAGCA

GCCCCAGCCTCTACAGAAGCAGCCACCACAGCCCCAGCAGCAGCAGAGACCCCAGCAGCAGCAG

CCACATCACCCTCAGACAGAGTCTGTCAACTCTTATTCTGCTTCTGGATCCACCAATCCATACA

TGAGACGGCCCAATCCAGTTAGTCCTTATCCAAACTCTTCACACACTTCAGATATCTATGGAAG

CACCAGCCCTATGAACTTCTATTCCACCTCATCTCAAGCTGCAGGTTCATATTTGAATTCTTCT

AATCCCATGAACCCTTACCCTGGGCTTTTGAATCAGAATACCCAATATCCATCATATCAATGCA

ATGGAAACCTATCAGTGGACAACTGCTCCCCATATCTGGGTTCCTATTCTCCCCAGTCTCAGCC

GATGGATCTGTATAGGTATCCAAGCCAAGACCCTCTGTCTAAGCTCAGTCTACCACCCATCCAT

ACACTTTACCAGCCAAGGTTTGGAAATAGCCAGAGTTTTACATCTAAATACTTAGGTTATGGAA

ACCAAAATATGCAGGGAGATGGTTTCAGCAGTTGTACCATTAGACCAAATGTACATCATGTAGG

GAAATTGCCTCCTTATCCCACTCATGAGATGGATGGCCACTTCATGGGAGCCACCTCTAGATTA

CCACCCAATCTGAGCAATCCAAACATGGACTATAAAAATGGTGAACATCATTCACCTTCTCACA

TAATCCATAACTACAGTGCAGCTCCGGGCATGTTCAACAGCTCTCTTCATGCCCTGCATCTCCA

AAACAAGGAGAATGACATGCTTTCCCACACAGCTAATGGGTTATCAAAGATGCTTCCAGCTCTT

AACCATGATAGAACTGCTTGTGTCCAAGGAGGCTTACACAAATTAAGTGATGCTAATGGTCAGG

AAAAGCAGCCATTGGCACTAGTCCAGGGTGTGGCTTCTGGTGCAGAGGACAACGATGAGGTCTG

GTCAGACAGCGAGCAGAGCTTTCTGGATCCTGACATTGGGGGAGTGGCCGTGGCTCCAACTCAT

GGGTCAATTCTCATTGAGTGTGCAAAGCGTGAGCTGCATGCCACAACCCCTTTAAAGAATCCCA

ATAGGAATCACCCCACCAGGATCTCCCTCGTCTTTTACCAGCATAAGAGCATGAATGAGCCAAA

ACATGGCTTGGCTCTTTGGGAAGCCAAAATGGCTGAAAAAGCCCGTGAGAAAGAGGAAGAGTGT
```

-continued

```
GAAAAGTATGGCCCAGACTATGTGCCTCAGAAATCCCATGGCAAAAAAGTGAAACGGGAGCCTG

CTGAGCCACATGAAACTTCAGAGCCCACTTACCTGCGTTTCATCAAGTCTCTTGCCGAAAGGAC

CATGTCCGTGACCACAGACTCCACAGTAACTACATCTCCATATGCCTTCACTCGGGTCACAGGG

CCTTACAACAGATATATATGAAGATATATATGATATCACCCCCTTTTGTTGGTTACCTCACTTG

AAAAGACCACAACCAACCTGTCAGTAGTATAGTTCTCATGACGTGGGCAGTGGGGAAAGGTCAC

AGTATTCATGACAAATGTGGTGGGAAAAACCTCAGCTCACCAGCAACAAAAGAGGTTATCTTAC

CATAGCACTTAATTTTCACTGGCTCCCAAGTGGTCACAGATGGCATCTAGGAAAAGACCAAAGC

ATTCTATGCAAAAGAAGGTGGGGAAGAAAGTGTTCCGCAATTTACATTTTTAAACACTGGTTC

TATTATTGGACGAGATGATATGTAAATGTGATCCCCCCCCCCCGCTTACAACTCTACACATCTG

TGACCACTTTTAATAATATCAAGTTTGCATAGTCATGGAACACAAATCAAACAAGTACTGTAGT

ATTACAGTGACAGGAATCTTAAAATACCATCTGGTGCTGAATATATGATGTACTGAAATACTGG

AATTATGGCTTTTTGAAATGCAGTTTTTACTGTAATCTTAACTTTTATTTATCAAAATAGCTAC

AGGAAACATGAATAGCAGGAAAACACTGAATTTGTTTGGATGTTCTAAGAAATGGTGCTAAGAA

AATGGTGTCTTTAATAGCTAAAAATTTAATGCCTTTATATCATCAAGATGCTATCAGTGTACTC

CAGTGCCCTTGAATAATAGGGGTACCTTTTCATTCAAGTTTTTATCATAATTACCTATTCTTAC

ACAAGCTTAGTTTTTAAAATGTGGACATTTTAAAGGCCTCTGGATTTTGCTCATCCAGTGAAGT

CCTTGTAGGACAATAAACGTATATATGTACATATATACACAAACATGTATATGTGCACACACAT

GTATATGTATAAATATTTTAAATGGTGTTTTAGAAGCACTTTGTCTACCTAAGCTTTGACAACT

TGAACAATGCTAAGGTACTGAGATGTTTAAAAAACAAGTTTACTTTCATTTTAGAATGCAAAGT

TGATTTTTTTAAGGAAACAAAGAAAGCTTTTAAAATATTTTTGCTTTTAGCCATGCATCTGCTG

ATGAGCAATTGTGTCCATTTTTAACACAGCCAGTTAAATCCACCATGGGGCTTACTGGATTCAA

GGGAATACGTTAGTCCACAAAACATGTTTTCTGGTGCTCATCTCACATGCTATACTGTAAAACA

GTTTTATACAAAATTGTATGACAAGTTCATTGCTCAAAAATGTACAGTTTTAAGAATTTTCTAT

TAACTGCAGGTAATAATTAGCTGCATGCTGCAGACTCAACAAAGCTAGTTCACTGAAGCCTATG

CTATTTTATGGATCATAGGCTCTTCAGAGAACTGAATGGCAGTCTGCCTTTGTGTTGATAATTA

TGTACATTGTGACGTTGTCATTTCTTAGCTTAAGTGTCCTCTTTAACAAGAGGATTGAGCAGAC

TGATGCCTGCATAAGATGAATAAACAGGGTTAGTTCCATGTGAATCTGTCAGTTAAAAAGAAAC

AAAAACAGGCAGCTGGTTTGCTGTGGTGGTTTTAAATCATTAATTTGTATAAAGAAGTGAAAGA

GTTGTATAGTAAATTAAATTGTAAACAAAACTTTTTTAATGCAATGCTTTAGTATTTTAGTACT

GTAAAAAAATTAAATATATACATATATATATATATATATATATATATATATATGAGTTTGAAGC

AGAATTCACATCATGATGGTGCTACTCAGCCTGCTACAAATATATCATAATGTGAGCTAAGAAT

TCATTAAATGTTTGAGTGATGTTCCTACTTGTCATATACCTCAACACTAGTTTGGCAATAGGAT

ATTGAACTGAGAGTGAAAGCATTGTGTACCATCATTTTTTTCCAAGTCCTTTTTTTTATTGTTA

AAAAAAAAGCATACCTTTTTTCAATACTTGATTTCTTAGCAAGTATAACTTGAACTTCAACCT

TTTTGTTCTAAAAATTCAGGGATATTTCAGCTCATGCTCTCCCTATGCCAACATGTCACCTGTG

TTTATGTAAAATTGTTGTAGGTTAATAAATATATTCTTTGTCAGGGATTTAACCCTTTTATTTT

GAATCCCTTCTATTTTACTTGTACATGTGCTGATGTAACTAAAACTAATTTTGTAAATCTGTTG

GCTCTTTTTATTGTAAAGAAAAGCATTTTAAAAGTTTGAGGAATCTTTTGACTGTTTCAAGCAG

GAAAAAAAAATTACATGAAAATAGAATGCACTGAGTTGATAAAGGGAAAAATTGTAAGGCAGGA

GTTTGGCAAGTGGCTGTTGGCCAGAGACTTACTTGTAACTCTCTAAATGAAGTTTTTTTGATCC

TGTAATCACTGAAGGTACATACTCCATGTGGACTTCCCTTAAACAGGCAAACACCTACAGGTAT
```

-continued

```
GGTGTGCAACAGATTGTACAATTACATTTTGGCCTAAATACATTTTTGCTTACTAGTATTTAAA

ATAAATTCTTAATCAGAGGAGGCCTTTGGGTTTTATTGGTCAAATCTTTGTAAGCTGGCTTTTG

TCTTTTTAAAAAATTTCTTGAATTTGTGGTTGTGTCCAATTTGCAAACATTTCCAAAAATGTTT

GCTTTGCTTACAAACCACATGATTTTAATGTTTTTTGTATACCATAATATCTAGCCCCAAACAT

TTGATTACTACATGTGCATTGGTGATTTTGATCATCCATTCTTAATATTTGATTTCTGTGTCAC

CTACTGTCATTTGTTAAACTGCTGGCCAACAAGAACAGGAAGTATAGTTTGGGGGGTTGGGGAG

AGTTTACATAAGGAAGAGAAGAAATTGAGTGGCATATTGTAAATATCAGATCTATAATTGTAAA

TATAAAACCTGCCTCAGTTAGAATGAATGGAAAGCAGATCTACAATTTGCTAATATAGGAATAT

CAGGTTGACTATATAGCCATACTTGAAAATGCTTCTGAGTGGTGTCAACTTTACTTGAATGAAT

TTTTCATCTTGATTGACGCACAGTGATGTACAGTTCACTTCTGAAGCTAGTGGTTAACTTGTGT

AGGAAACTTTTGCAGTTTGACACTAAGATAACTTCTGTGTGCATTTTTCTATGCTTTTTTAAAA

ACTAGTTTCATTTCATTTTCATGAGATGTTTGGTTTATAAGATCTGAGGATGGTTATAAATACT

GTAAGTATTGTAATGTTATGAATGCAGGTTATTTGAAAGCTGTTTATTATTATATCATTCCTGA

TAATGCTATGTGAGTGTTTTTAATAAAATTTATATTTATTTAATGCACTCTAAGTGTTGTCTTC

CT
```

By "transforming growth factor receptor 2 (TGFBRII) polypeptide" is meant a protein having at least about 85% sequence identity to NCBI Accession No. ABG65632.1 or a fragment thereof and having immunosuppressive activity. An exemplary amino acid sequence is provided below.

```
>ABG65632.1 transforming growth factor beta
receptor II [Homo sapiens]
MGRGLLRGLWPLHIVLWTRIASTIPPHVQKSVNNDMIVTDNNGAVKFPQL

CKFCDVRFSTCDNQKSCMSNCSITSICEKPQEVCVAVWRKNDENITLETV

CHDPKLPYHDFILEDAASPKCIMKEKKKPGETFFMCSCSSDECNDNLLFS

EEYNTSNPDLLLVIFQVTGISLLPPLGVAISVLILFYCYRVNRQQKLSST

WETGKTRKLMEFSEHCAIILEDDRSDISSTCANNINHNTELLPIELDTLV

GKGRFAEVYKAKLKQNTSEQFETVAVKIFPYEEYASWKTEKDIFSDINLK

HENILQFLTAEERKTELGKQYWLITAFHAKGNLQEYLTRHVISWEDLRKL

GSSLARGIAHLHSDHTPCGRPKMPIVHRDLKSSNILVKNDLTCCLCDFGL

SLRLDPTLSVDDLANSGQVGTARYMAPEVLESRMNLENVESFKQTDVYSM

ALVLWEMTSRCNAVGEVKDYEPPFGSKVREHPCVESMKDNVLRDRGRPEI

PSFWLNHQGIQMVCETLTECWDHDPEARLTAQCVAERFSELEHLDRLSGR

SCSEEKIPEDGSLNTTK
```

By "transforming growth factor receptor 2 (TGFBRII) polynucleotide" is meant a nucleic acid that encodes a TGFBRII polypeptide. The TGFBRII gene encodes a transmembrane protein having serine/threonine kinase activity. An exemplary TGFBRII nucleic acid is provided below.

```
>M85079.1 Human TGF-beta type II receptor
mRNA, complete cds
GTTGGCGAGGAGTTTCCTGTTTCCCCCGCAGCGCTGAGTTGAAGTTGAGT

GAGTCACTCGCGCGCACGGAGCGACGACACCCCCGCGCGTGCACCCGCTC
```

-continued
```
GGGACAGGAGCCGGACTCCTGTGCAGCTTCCCTCGGCCGCCGGGGGCCTC

CCCGCGCCTCGCCGGCCTCCAGGCCCCTCCTGGCTGGCGAGCGGGCGCCA

CATCTGGCCCGCACATCTGCGCTGCCGGCCCGGCGCGGGGTCCGGAGAGG

GCGCGGCGCGGAGCGCAGCCAGGGGTCCGGGAAGGCGCCGTCCGTGCGCT

GGGGGCTCGGTCTATGACGAGCAGCGGGGTCTGCCATGGGTCGGGGGCTG

CTCAGGGGCCTGTGGCCGCTGCACATCGTCCTGTGGACGCGTATCGCCAG

CACGATCCCACCGCACGTTCAGAAGTCGGTTAATAACGACATGATAGTCA

CTGACAACAACGGTGCAGTCAAGTTTCCACAACTGTGTAAATTTTGTGAT

GTGAGATTTTCCACCTGTGACAACCAGAAATCCTGCATGAGCAACTGCAG

CATCACCTCCATCTGTGAGAAGCCACAGGAAGTCTGTGTGGCTGTATGGA

GAAAGAATGACGAGAACATAACACTAGAGACAGTTTGCCATGACCCCAAG

CTCCCCTACCATGACTTTATTCTGGAAGATGCTGCTTCTCCAAAGTGCAT

TATGAAGGAAAAAAAAAAGCCTGGTGAGACTTTCTTCATGTGTTCCTGTA

GCTCTGATGAGTGCAATGACAACATCATCTTCTCAGAAGAATATAACACC

AGCAATCCTGACTTGTTGCTAGTCATATTTCAAGTGACAGGCATCAGCCT

CCTGCCACCACTGGGAGTTGCCATATCTGTCATCATCATCTTCTACTGCT

ACCGCGTTAACCGGCAGCAGAAGCTGAGTTCAACCTGGGAAACCGGCAAG

ACGCGGAAGCTCATGGAGTTCAGCGAGCACTGTGCCATCATCCTGGAAGA

TGACCGCTCTGACATCAGCTCCACGTGTGCCAACAACATCAACCACAACA

CAGAGCTGCTGCCCATTGAGCTGGACACCCTGGTGGGGAAAGGTCGCTTT

GCTGAGGTCTATAAGGCCAAGCTGAAGCAGAACACTTCAGAGCAGTTTGA

GACAGTGGCAGTCAAGATCTTTCCCTATGAGGAGTATGCCTCTTGGAAGA

CAGAGAAGGACATCTTCTCAGACATCAATCTGAAGCATGAGAACATACTC

CAGTTCCTGACGGCTGAGGAGCGGAAGACGGAGTTGGGGAAACAATACTG
```

-continued

```
GCTGATCACCGCCTTCCACGCCAAGGGCAACCTACAGGAGTACCTGACGC

GGCATGTCATCAGCTGGGAGGACCTGCGCAAGCTGGGCAGCTCCCTCGCC

CGGGGGATTGCTCACCTCCACAGTGATCACACTCCATGTGGGAGGCCCAA

GATGCCCATCGTGCACAGGGACCTCAAGAGCTCCAATATCCTCGTGAAGA

ACGACCTAACCTGCTGCCTGTGTGACTTTGGGCTTTCCCTGCGTCTGGAC

CCTACTCTGTCTGTGGATGACCTGGCTAACAGTGGGCAGGTGGGAACTGC

AAGATACATGGCTCCAGAAGTCCTAGAATCCAGGATGAATTTGGAGAATG

CTGAGTCCTTCAAGCAGACCGATGTCTACTCCATGGCTCTGGTGCTCTGG

GAAATGACATCTCGCTGTAATGCAGTGGGAGAAGTAAAAGATTATGAGCC

TCCATTTGGTTCCAAGGTGCGGGAGCACCCCTGTGTCGAAAGCATGAAGG

ACAACGTGTTGAGAGATCGAGGGCGACCAGAAATTCCCAGCTTCTGGCTC

AACCACCAGGGCATCCAGATGGTGTGTGAGACGTTGACTGAGTGCTGGGA

CCACGACCCAGAGGCCCGTCTCACAGCCCAGTGTGTGGCAGAACGCTTCA

GTGAGCTGGAGCATCTGGACAGGCTCTCGGGGAGGAGCTGCTCGGAGGAG

AAGATTCCTGAAGACGGCTCCCTAAACACTACCAAATAGCTCTTATGGGG

CAGGCTGGGCATGTCCAAAGAGGCTGCCCCTCTCACCAAA
```

By "T Cell Immunoreceptor with Ig and ITIM Domains (TIGIT) polypeptide" is meant a protein having at least about 85% sequence identity to NCBI Accession No. ACD74757.1 or a fragment thereof and having immunomodulatory activity. An exemplary TIGIT amino acid sequence is provided below.

```
>ACD74757.1 T cell immunoreceptor with
Ig and ITIM domains [Homo sapiens]
MRWCLLLIWAQGLRQAPLASGMMTGTIETTGNISAEKGGSIILQCHLSST

TAQVTQVNWEQQDQLLAICNADLGWHISPSFKDRVAPGPGLGLTLQSLTV

NDTGEYFCIYHTYPDGTYTGRIFLEVLESSVAEHGARFQIPLLGAMAATL

VVICTAVIVVVALTRKKKALRIHSVEGDLRRKSAGQEEWSPSAPSPPGSC

VQAEAAPAGLCGEQRGEDCAELHDYFNVLSYRSLGNCSFFTETG
```

By "T Cell Immunoreceptor With Ig And ITIM Domains (TIGIT) polynucleotide" is meant a nucleic acid encoding a TIGIT polypeptide. The TIGIT gene encodes an inhibitory immune receptor that is associated with neoplasia and T cell exhaustion. An exemplary nucleic acid sequence is provided below.

```
>EU675310.1 Homo sapiens T cell immunoreceptor
with Ig and ITIM domains (TIGIT) mRNA,
complete cds
CGTCCTATCTGCAGTCGGCTACTTTCAGTGGCAGAAGAGGCCACATCTGC

TTCCTGTAGGCCCTCTGGGCAGAAGCATGCGCTGGTGTCTCCTCCTGATC

TGGGCCCAGGGGCTGAGGCAGGCTCCCCTCGCCTCAGGAATGATGACAGG

CACAATAGAAACAACGGGGAACATTTCTGCAGAGAAAGGTGGCTCTATCA

TCTTACAATGTCACCTCTCCTCCACCACGGCACAAGTGACCCAGGTCAAC

TGGGAGCAGCAGGACCAGCTTCTGGCCATTTGTAATGCTGACTTGGGGTG

GCACATCTCCCCATCCTTCAAGGATCGAGTGGCCCCAGGTCCCGGCCTGG
```

```
GCCTCACCCTCCAGTCGCTGACCGTGAACGATACAGGGGAGTACTTCTGC

ATCTATCACACCTACCCTGATGGGACGTACACTGGGAGAATCTTCCTGGA

GGTCCTAGAAAGCTCAGTGGCTGAGCACGGTGCCAGGTTCCAGATTCCAT

TGCTTGGAGCCATGGCCGCGACGCTGGTGGTCATCTGCACAGCAGTCATC

GTGGTGGTCGCGTTGACTAGAAAGAAGAAAGCCCTCAGAATCCATTCTGT

GGAAGGTGACCTCAGGAGAAAATCAGCTGGACAGGAGGAATGGAGCCCCA

GTGCTCCCTCACCCCCAGGAAGCTGTGTCCAGGCAGAAGCTGCACCTGCT

GGGCTCTGTGGAGAGCAGCGGGGAGAGGACTGTGCCGAGCTGCATGACTA

CTTCAATGTCCTGAGTTACAGAAGCCTGGGTAACTGCAGCTTCTTCACAG

AGACTGGTTAGCAACCAGAGGCATCTTCTGG
```

As used herein "transduction" means to transfer a gene or genetic material to a cell via a viral vector.

"Transformation," as used herein refers to the process of introducing a genetic change in a cell produced by the introduction of exogenous nucleic acid.

"Transfection" refers to the transfer of a gene or genetical material to a cell via a chemical or physical means.

By "translocation" is meant the rearrangement of nucleic acid segments between non-homologous chromosomes.

By "transmembrane domain" is meant an amino acid sequence that inserts into a lipid bilayer, such as the lipid bilayer of a cell or virus or virus-like particle. A transmembrane domain can be used to anchor a protein of interest (e.g., a CAR) to a membrane. The transmembrane domain may be derived either from a natural or from a synthetic source. Where the source is natural, the domain may be derived from any membrane-bound or transmembrane protein. Transmembrane domains for use in the disclosed CARs can include at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. In some embodiments, the transmembrane domain is derived from CD4, CD8α, CD28 and CD3ζ. In some embodiments, the transmembrane domain is a CD8α hinge and transmembrane domain.

As used herein, the terms "treat," treating," "treatment," and the like refer to reducing or ameliorating a disorder and/or a symptom associated therewith or obtaining a desired pharmacologic and/or physiologic effect. It will be appreciated that, although not precluded, treating a disorder or condition does not require that the disorder, condition or symptoms associated therewith be completely eliminated. In some embodiments, the effect is therapeutic, i.e., without limitation, the effect partially or completely reduces, diminishes, abrogates, abates, alleviates, decreases the intensity of, or cures a disease and/or adverse symptom attributable to the disease. In some embodiments, the effect is preventative, i.e., the effect protects or prevents an occurrence or reoccurrence of a disease or condition. To this end, the presently disclosed methods comprise administering a therapeutically effective amount of a compositions as described herein.

The term "uracil glycosylase inhibitor" or "UGI" is meant an agent that inhibits the uracil-excision repair system. In one embodiment, the agent is a protein or fragment thereof that binds a host uracil-DNA glycosylase and prevents removal of uracil residues from DNA. In an embodiment, a UGI is a protein, a fragment thereof, or a domain that is capable of inhibiting a uracil-DNA glycosylase base-excision repair enzyme. In some embodiments, a UGI domain comprises a wild-type UGI or a modified version thereof. In some embodiments, a UGI domain comprises a fragment of the exemplary amino acid sequence set forth below. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or 100% of the exemplary UGI sequence provided below. In some embodiments, a UGI comprises an amino acid sequence that is homologous to the exemplary UGI amino acid sequence or fragment thereof, as set forth below. In some embodiments, the UGI, or a portion thereof, is at least 70%, at least 75%, at least 80%, at least 85%, at least 90%, at least 95%, at least 96%, at least 97%, at least 98%, at least 99%, at least 99.5%, at least 99.9%, or 100% identical to a wild-type UGI or a UGI sequence, or portion thereof, as set forth below. An exemplary UGI comprises an amino acid sequence as follows: >splP14739IUNGI_BPPB2 Uracil-DNA glycosylase inhibitor MTNLSDIIEKETGKQLVIQESILMLPEEVEEVI-GNKPESDILVHTAYDESTDENVMLLT SD APEYKP-WALVIQDSNGENKIKML (SEQ ID NO: 106). The term "vector" refers to a means of introducing a nucleic acid sequence into a cell, resulting in a transformed cell. Vectors include plasmids, transposons, phages, viruses, liposomes, and episome. "Expression vectors" are nucleic acid sequences comprising the nucleotide sequence to be expressed in the recipient cell. Expression vectors may include additional nucleic acid sequences to promote and/or facilitate the expression of the of the introduced sequence such as start, stop, enhancer, promoter, and secretion sequences.

By "zeta chain of T cell receptor associated protein kinase 70 (ZAP70) polypeptide" is meant a protein having at least about 85% amino acid sequence identity to NCBI Accession No. AAH53878.1 and having kinase activity. An exemplary amino acid sequence is provided below.

>AAH53878.1 Zeta-chain (TCR) associated
protein kinase 70kDa [Homo sapiens]
MPDPAAHLPFFYGSISRAEAEEHLKLAGMADGLFLLRQCLRSLGGYVLSL

VHDVRFHHFPIERQLNGTYAIAGGKAHCGPAELCEFYSRDPDGLPCNLRK

PCNRPSGLEPQPGVFDCLRDAMVRDYVRQTWKLEGEALEQAIISQAPQVE

KLIATTAHERMPWYHSSLTREEAERKLYSGAQTDGKFLLRPRKEQGTYAL

SLIYGKTVYHYLTSQDKAGKYCIPEGTKFDTLWQLVEYLKLKADGLIYCL

KEACPNSSASNASGAAAPTLPAHPSTLTHPQRRIDTLNSDGYTPEPARIT

SPDKPRPMPMDTSVYESPYSDPEELKDKKLFLKRDNLLIADIELGCGNFG

SVRQGVYRMRKKQIDVAIKVLKQGTEKADTEEMMREAQIMHQLDNPYIVR

LIGVCQAEALMLVMEMAGGGPLHKFLVGKREEIPVSNVAELLHQVSMGMK

YLEEKNFVHRDLAARNVLLVNRHYAKISDFGLSKALGADDSYYTARSAGK

WPLKWYAPECINFRKFSSRSDVWSYGVTMWEALSYGQKPYKKMKGPEVMA

FTEQGKRMECPPECPPELYALMSDCWIYKWEDRPDFLTVEQRMRACYYSL

ASKVEGPPGSTQKAEAACA

By "zeta chain of T cell receptor associated protein kinase 70 (ZAP70) polynucleotide" is meant a nucleic acid encoding a ZAP70 polypeptide. The ZAP70 gene encodes a tyrosine kinase that is involved in T cell development and lymphocyte activation. Absence of functional ZAP10 can lead to a severe combined immunodeficiency characterized by the lack of CD8+ T cells. An exemplary ZAP70 nucleic acid sequence is provided below.

>BC053878.1 Homo sapiens zeta-chain
(TCR) associated protein kinase 70kDa, mRNA
(cDNA clone MGC:61743 IMAGE:5757161),
complete cds
GCTTGCCGGAGCTCAGCAGACACCAGGCCTTCCGGGCAGGCCTGGCCCAC

CGTGGGCCTCAGAGCTGCTGCTGGGGCATTCAGAACCGGCTCTCCATTGG

CATTGGGACCAGAGACCCCGCAAGTGGCCTGTTTGCCTGGACATCCACCT

GTACGTCCCCAGGTTTCGGGAGGCCCAGGGGCGATGCCAGACCCCGCGGC

GCACCTGCCCTTCTTCTACGGCAGCATCTCGCGTGCCGAGGCCGAGGAGC

ACCTGAAGCTGGCGGGCATGGCGGACGGGCTCTTCCTGCTGCGCCAGTGC

CTGCGCTCGCTGGGCGGCTATGTGCTGTCGCTCGTGCACGATGTGCGCTT

CCACCACTTTCCCATCGAGCGCCAGCTCAACGGCACCTACGCCATTGCCG

GCGGCAAAGCGCACTGTGGACCGGCAGAGCTCTGCGAGTTCTACTCGCGC

GACCCCGACGGGCTGCCCTGCAACCTGCGCAAGCCGTGCAACCGGCCGTC

GGGCCTCGAGCCGCAGCCGGGGGTCTTCGACTGCCTGCGAGACGCCATGG

TGCGTGACTACGTGCGCCAGACGTGGAAGCTGGAGGGCGAGGCCCTGGAG

CAGGCCATCATCAGCCAGGCCCCGCAGGTGGAGAAGCTCATTGCTACGAC

GGCCCACGAGCGGATGCCCTGGTACCACAGCAGCCTGACGCGTGAGGAGG

CCGAGCGCAAACTTTACTCTGGGGCGCAGACCGACGGCAAGTTCCTGCTG

AGGCCGCGGAAGGAGCAGGGCACATACGCCCTGTCCCTCATCTATGGGAA

GACGGTGTACCACTACCTCATCAGCCAAGACAAGGCGGGCAAGTACTGCA

TTCCCGAGGGCACCAAGTTTGACACGCTCTGGCAGCTGGTGGAGTATCTG

AAGCTGAAGGCGGACGGGCTCATCTACTGCCTGAAGGAGGCCTGCCCCAA

CAGCAGTGCCAGCAACGCCTCAGGGGCTGCTGCTCCCACACTCCCAGCCC

ACCCATCCACGTTGACTCATCCTCAGAGACGAATCGACACCCTCAACTCA

GATGGATACACCCCTGAGCCAGCACGCATAACGTCCCCAGACAAACCGCG

GCCGATGCCCATGGACACGAGCGTGTATGAGAGCCCCTACAGCGACCCAG

AGGAGCTCAAGGACAAGAAGCTCTTCCTGAAGCGCGATAACCTCCTCATA

GCTGACATTGAACTTGGCTGCGGCAACTTTGGCTCAGTGCGCCAGGGCGT

GTACCGCATGCGCAAGAAGCAGATCGACGTGGCCATCAAGGTGCTGAAGC

AGGGCACGGAGAAGGCAGACACGGAAGAGATGATGCGCGAGGCGCAGATC

ATGCACCAGCTGGACAACCCCTACATCGTGCGGCTCATTGGCGTCTGCCA

GGCCGAGGCCCTCATGCTGGTCATGGAGATGGCTGGGGGCGGGCCGCTGC

ACAAGTTCCTGGTCGGCAAGAGGGAGGAGATCCCTGTGAGCAATGTGGCC

GAGCTGCTGCACCAGGTGTCCATGGGGATGAAGTACCTGGAGGAGAAGAA

CTTTGTGCACCGTGACCTGGCGGCCCGCAACGTCCTGCTGGTTAACCGGC

ACTACGCCAAGATCAGCGACTTTGGCCTCTCCAAAGCACTGGGTGCCGAC

GACAGCTACTACACTGCCCGCTCAGCAGGGAAGTGGCCGCTCAAGTGGTA

CGCACCCGAATGCATCAACTTCCGCAAGTTCTCCAGCCGCAGCGATGTCT

GGAGCTATGGGGTCACCATGTGGGAGGCCTTGTCCTACGGCCAGAAGCCC

-continued

```
TACAAGAAGATGAAAGGGCCGGAGGTCATGGCCTTCATCGAGCAGGGCAA

GCGGATGGAATGCCCACCAGAGTGTCCACCCGAACTGTACGCACTCATGA

GTGACTGCTGGATCTACAAGTGGGAGGATCGCCCCGACTTCCTGACCGTG

GAGCAGCGCATGCGAGCCTGTTACTACAGCCTGGCCAGCAAGGTGGAAGG

GCCCCCAGGCAGCACACAGAAGGCTGAGGCTGCCTGTGCCTGAGCTCCCG

CTGCCCAGGGGAGCCCTCCACACCGGCTCTTCCCCACCCTCAGCCCCACC

CCAGGTCCTGCAGTCTGGCTGAGCCCTGCTTGGTTGTCTCCACACACAGC

TGGGCTGTGGTAGGGGGTGTCTCAGGCCACACCGGCCTTGCATTGCCTGC

CTGGCCCCCTGTCCTCTCTGGCTGGGGAGCAGGGAGGTCCGGGAGGGTGC

GGCTGTGCAGCCTGTCCTGGGCTGGTGGCTCCCGGAGGGCCCTGAGCTGA

GGGCATTGCTTACACGGATGCCTTCCCCTGGGCCCTGACATTGGAGCCTG

GGCATCCTCAGGTGGTCAGGCGTAGATCACCAGAATAAACCCAGCTTCCC

TCTTGAAAAAAAAAAAAAAAAAAAAAAAAAAAAAAAAAAAAAAAAAAAAAA

AAAAAAAAAAAAAAAAAA
```

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

DNA editing has emerged as a viable means to modify disease states by correcting pathogenic mutations at the genetic level. Until recently, all DNA editing platforms have functioned by inducing a DNA double strand break (DSB) at a specified genomic site and relying on endogenous DNA repair pathways to determine the product outcome in a semi-stochastic manner, resulting in complex populations of genetic products. Though precise, user-defined repair outcomes can be achieved through the homology directed repair (HDR) pathway, a number of challenges have prevented high efficiency repair using HDR in therapeutically-relevant cell types. In practice, this pathway is inefficient relative to the competing, error-prone non-homologous end joining pathway. Further, HDR is tightly restricted to the Gi and S phases of the cell cycle, preventing precise repair of DSBs in post-mitotic cells. As a result, it has proven difficult or impossible to alter genomic sequences in a user-defined, programmable manner with high efficiencies in these populations.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1A is an illustration of the TRAC protein, which is a key component in graft versus host disease. FIG. 1B is an illustration of the B2M protein, a component of the MHC class 1 antigen presenting complex present on nucleated cells that can be recognized by a host's CD8+ T cells.

FIG. 6 is a chart summarizing off-target binding sites of sgRNAs employed to disrupt target genes.

FIG. 7 is a graph summarizing flow cytometry (FC) data of the percentage of cells edited with BE4 or Cas9 that exhibit reduced protein expression. Cells were either gated to B2M or CD3, the latter being a proxy for TRAC expression.

FIG. 8A is a scatter plot of FACS data of unedited control cells. FIG. 8B is a scatter plot of FACS data of cells that have been edited at the B2M, TRAC, and PD1 loci.

FIG. 18 is graph showing that BE4 produced efficient, durable gene knockout with high product purity.

FIGS. 28A-B are depictions showing base editing approaches to silence genes for engineering CAR-T cells. FIG. 28A illustrates targets for CAR-T editing. FIG. 28B shows two strategies for silencing with base editors: creating a stop codon with CBE and splice disruption with CBE.

FIG. 31A illustrates the theoretical yield in contest of quad T-ALL edits for no electroporation (no EP; dark circles), EP only (dark squares), CBE Variant 1 (light, upright triangles), CBE Variant 2 (light, upside down triangles), and Cas9 (light diamonds). FIG. 31B illustrates viability of cells post electroporation. For each set of results at 24 hours (hr), 48 hr, 72 hr, 96 hr, and 168 hr, results are shown from right to left as no EP, EP only, CBE variant 1, CBE variant 2, and Cas9.

FIG. 37A is a flow chart depicting a protocol for producing TALL017 heterogenous thawed CD7 CAR-T cells. FIG. 37B is a flow chart depicting a protocol for producing TALL083 CD7 CAR-T cells. FIG. 37C is a scatter plot of fluorescence assisted cell sorting data demonstrating that TALL017 CAR-T cells are highly activated post-thaw.

FIG. 38 is a graph depicting total editing in TALL017 and TALL038 CD7 CAR-T cells by next generation sequencing (NGS).

FIG. 39A is a scatter plot of fluorescence assisted cell sorting data for TALL017 and TALL038 CD7 CAR-T cells. FIG. 39B is a graph depicting residual protein expression via FACS.

FIG. 44 is a flow chart depicting a CD7 CAR-T bead based potency protocol for in vitro characterization.

FIG. 45A is a graph depicting the release of IFNγ by TALL038 CD7 CAR-T cells. FIG. 45B is a graph depicting the release of TNFα, IL-10 and IL-2 by TALL038 CD7 CAR-T cells.

FIG. 47A is a graph depicting a primary challenge. FIG. 47B is a graph depicting a secondary challenge.

FIG. 49A is a graph depicting mean tumor burden. Total flux is measured on a linear scale. FIG. 49B is a graph depicting mean mouse weights.

FIG. 50A is a graph depicting mean tumor burden. Total flux is measured on a linear scale. FIG. 50B is a graph depicting mean tumor burden. Total flux is measured on a logarithmic scale.

FIGS. 51A-51B depict Bioluminescent Radiance Data at Day 38 Post CCRF Implant/Day 27 Post CD7 CAR-T Treatment (individual mice). FIG. 51A is a graph depicting mean tumor burden. Total flux is measured on a linear scale. FIG. 51B is a graph depicting mean tumor burden. Total flux is measured on a logarithmic scale.

FIG. 52A includes graphs depicting mean tumor burden. Total flux is measured on a linear scale (Top) and on a logarithmic scale (bottom). FIG. 52B includes graphs depicting mean tumor burden. Total flux is measured on a linear scale (Top) and on a logarithmic scale (bottom).

FIG. 54 is a graph depicting editing efficiency via NGS of CD5 gRNA candidates g103 and g104 in combination with BE4.

FIGS. 59A-59B depict cytokine (IFNγ) production by CD5 CAR LVV constructs using sgRNA 103 or sgRNA 104 in the presence of CD5+ CCRF-CEM leukemia cell lines. FIG. 59A (left) is a graph depicting IFNγ production with CD5 CAR LVV (LV63-69) transduced T cells alone or with CCRF cells edited using sgRNA 103. FIG. 59A (right) is a graph depicting IFNγ production with CD5 CAR LVV (LV63-69) transduced T cells alone or with CCRF cells edited using sgRNA 104. FIG. 59A (bottom) is a graph depicting IFNγ production using unedited CD5 CAR LVV (LV63-69) transduced T cells or CCRF cells. FIG. 59B (top) is a graph depicting IFNγ production with CD5 CAR LVV (LV63-69) transduced T cells alone either unedited or edited using sgRNA 103 or 104. FIG. 59B (bottom) is a graph depicting IFNγ production with CD5 CAR LVV (LV63-69) transduced CCRF cells either unedited or edited using sgRNA 103 or 104.

DETAILED DESCRIPTION OF THE INVENTION

Figure 1B:
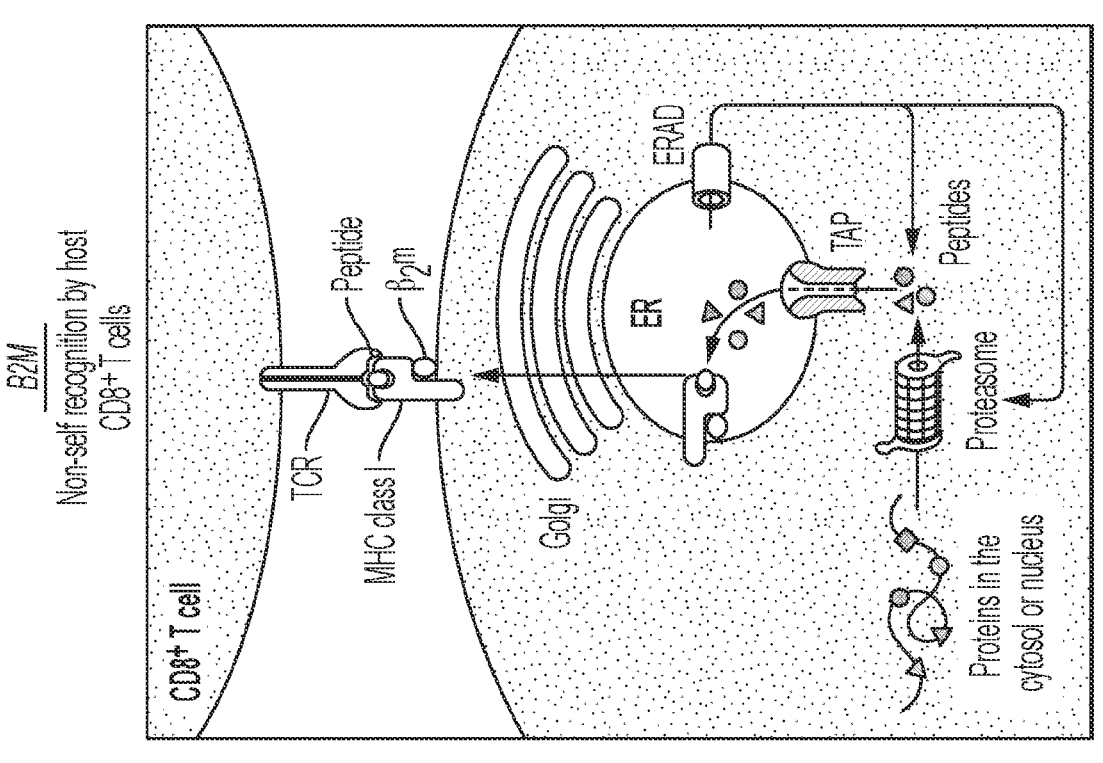
FIGS. 1A-1B are illustrations of three proteins that impact T cell function.

The present invention features genetically modified immune cells having enhanced anti-neoplasia activity, resistance to immune suppression, and decreased risk of eliciting a graft versus host reaction or a host versus graft reaction, or a combination thereof. The present invention also features methods for producing and using these modified immune cells (e.g., immune effector cells, such as T cells).

In one embodiment, a subject having or having a propensity to develop graft versus host disease (GVHD) is administered a CAR-T cell that lacks or has reduced levels of functional TRAC. In one embodiment, a subject having or having a propensity to develop host versus graft disease (HVGD) is administered a CAR-T cell that lacks or has reduced levels of functional beta2 microglobulin (B2M).

The modification of immune effector cells to express chimeric antigen receptors and to knockout or knockdown specific genes to diminish the negative impact that their expression can have on immune cell function is accomplished using a base editor system comprising a cytidine deaminase or adenosine deaminase as described herein.

Autologous, patient-derived chimeric antigen receptor-T cell (CAR-T) therapies have demonstrated remarkable efficacy in treating some hematologic cancers. While these products have led to significant clinical benefit for patients, the need to generate individualized therapies creates substantial manufacturing challenges and financial burdens. Allogeneic CAR-T therapies were developed as a potential solution to these challenges, having similar clinical efficacy profiles to autologous products while treating many patients with cells derived from a single healthy donor, thereby substantially reducing cost of goods and lot-to-lot variability.

Most first-generation allogeneic CAR-Ts use nucleases to introduce two or more targeted genomic DNA double strand breaks (DSBs) in a target T cell population, relying on error-prone DNA repair to generate mutations that knock out target genes in a semi-stochastic manner. Such nuclease-based gene knockout strategies aim to reduce the risk of graft-versus-host-disease and host rejection of CAR-Ts. However, the simultaneous induction of multiple DSBs results in a final cell product containing large-scale genomic rearrangements such as balanced and unbalanced translocations, and a relatively high abundance of local rearrangements including inversions and large deletions. Furthermore, as increasing numbers of simultaneous genetic modifications are made by induced DSBs, considerable genotoxicity is observed in the treated cell population. This has the potential to significantly reduce the cell expansion potential from each manufacturing run, thereby decreasing the number of patients that can be treated per healthy donor.

Base editors (BEs) are a class of emerging gene editing reagents that enable highly efficient, user-defined modification of target genomic DNA without the creation of DSBs. Here, an alternative means of producing allogeneic CAR-T cells is proposed by using base editing technology to reduce or eliminate detectable genomic rearrangements while also improving cell expansion. As shown herein, in contrast to a nuclease-only editing strategy, concurrent modification of one or more, for example, one, two, three, four, five, six, seven, eight, night, ten, or more, genetic loci by base editing produces highly efficient gene knockouts with no detectable translocation events.

In some embodiments, at least one or more genes or regulatory elements thereof are modified in an immune cell with the base editing compositions and methods provided herein. In some embodiments, the at least one or more genes or regulatory elements thereof are selected from ACAT1, ACLY, ADORA2A, AXL, B2M, BATF, BCL2L11, BTLA, CAMK2D, cAMP, CASP8, CBLB, CCR5, CD2, CD3D, CD3E, CD3G, CD4, CD5, CD7, CD8A, CD33, CD38, CD52, CD70, CD82, CD86, CD96, CD123, CD160, CD244, CD276, CDK8, CDKN1B, Chi3l1, CIITA, CISH, CSF2CSK, CTLA-4, CUL3, Cyp11a1, DCK, DGKA, DGKZ, DHX37, ELOB(TCEB2), ENTPD1 (CD39), FADD, FAS, GATA3, IL6, IL6R, IL10, IL10RA, IRF4, IRF8, JUNB, Lag3, LAIR-1 (CD305), LDHA, LIF, LYN, MAP4K4, MAPK14, MCJ, MEF2D, MGAT5, NR4A1, NR4A2, NR4A3, NT5E (CD73), ODC1, OTULINL (FAM105A), PAGI, PDCD1, PDIA3, PHD1 (EGLN2), PHD2 (EGLN1), PHD3 (EGLN3), PIK3CD, PIKFYVE, PPARa, PPARd, PRDMI1, PRKACA, PTEN, PTPN2, PTPN6, PTPN11, PVRIG (CDI12R), RASA2, RFXANK, SELPG/PSGL1, SIGLEC15, SLA, SLAMF7, SOCS1, Spry1, Spry2, STK4, SUV39, HITET2, TGFbRII, TIGIT, Tim-3, TMEM222, TNFAIP3, TNFRSF8 (CD30), TNFRSF10B, TOX, TOX2, TRAC, TRBC1, TRBC2, UBASH3A, VHL, VISTA, XBP1, YAP1, and ZC3H12A. In some embodiments, the at least one or more genes or regulatory elements thereof are selected from CD3, CD5, CD7, CD33, CD123, TRAC, LAG-3, FAS, CD52, TRBC1, TRBC2, B2M, and CIITA and PD-1. In some embodiments, the modified immune cell comprises a modification in CD5 and at least one or more genes or regulatory elements thereof selected from TRAC, LAG-3, FAS, CD52, TRBC1, TRBC2, B2M, and CIITA and PD-1. In some embodiments, the modified immune cell comprises a modification in CD7 and at least one or more genes or regulatory elements thereof selected from TRAC, LAG-3, FAS, CD52, TRBC1, TRBC2, B2M, and CIITA and PD-1. In some embodiments, the modified immune cell comprises a modification in CD33 and at least one or more genes or regulatory elements thereof selected from TRAC, LAG-3, FAS, CD52, TRBC1, TRBC2, B2M, and CIITA and PD-1. In some embodiments, the modified immune cell comprises a modification in CD3 and at least one or more genes or regulatory elements thereof selected from TRAC, LAG-3, FAS, CD52, TRBC1, TRBC2, B2M, and CIITA and PD-1. In some embodiments, the modified immune cell comprises a modification in CD123 and at least one or more genes or regulatory elements thereof selected from TRAC, LAG-3, FAS, CD52, TRBC1, TRBC2, B2M, and CIITA and PD-1. Multiplex editing of genes may be useful in the creation of CAR-T cell therapies with improved therapeutic properties. This method addresses known limitations of multiplex-edited T cell products and are a promising development towards the next generation of precision cell-based therapies.

In one aspect, provided herein is a universal CAR-T cell. In some embodiments, the CAR-T cell described herein is an allogeneic cell. In some embodiments, the universal CAR-T cell is an allogeneic T cell that can be used to express a desired CAR, and can be universally applicable, irrespective of the donor and the recipient's immunogenic compatibility. A$_n$ allogenic immune cell may be derived from one or more donors. In certain embodiments, the allogenic immune cell is derived from a single human donor. For example, the allogenic T cell may be derived from PBMCs of a single healthy human donor. In certain embodiments, the allogenic immune cell is derived from multiple human donors. In some embodiments, an universal CAR-T cell may be generated, as described herein by using gene modification to introduce concurrent edits at multiple gene loci, for example, three, four, five, six, seven, eight, nine, ten or more genetic loci. A modification, or concurrent modifications as described herein may be a genetic editing, such as a base editing, generated by a base editor. The base editor may be a C base editor or A base editor. As is discussed herein, base editing may be used to achieve a gene disruption, such that the gene is not expressed. A modification by base editing may be used to achieve a reduction in gene expression. In some embodiments base editor may be used to introduce a genetic modification such that the edited gene does not generate a structurally or functionally viable protein product. In some embodiments, a modification, such as the concurrent modifications described herein may comprise a genetic editing, such as base editing, such that the expression or functionality of the gene product is altered in any way. For example, the expression of the gene product may be enhanced or upregulated as compared to baseline expression levels. In some embodiments the activity or functionality of the gene product may be upregulated as a result of the base editing, or multiple base editing events acting in concert.

In some embodiments, generation of universal CAR-T cell may be advantageous over autologous T cell (CAR-T), which may be difficult to generate for an urgent use. Allogeneic approaches are preferred over autologous cell preparation for a number of situations related to uncertainty of engineering autologous T cells to express a CAR and finally achieving the desired cellular products for a transplant at the time of medical emergency. However, for allogeneic T cells, or "off-the-shelf" T cells, it is important to carefully negotiate the host's reactivity to the CAR-T cells (HVGD) as well as the allogeneic T cell's potential hostility towards a host cell (GVHD). Given the scenario, base editing can be successfully used to generate multiple simultaneous gene editing events, such that (a) it is possible to reduce or down regulate expression of antigens to generate a fratricide resistant immune cell; (b) it is possible to generate a platform cell type that is devoid of or expresses low amounts of an endogenous T cell receptor, for example, a TCR alpha chain (such a via base editing of TRAC), or a TCR beta chain (such a through base editing of TRBC1/TRBC2); and/or (c) it is possible to reduce or down regulate expression of antigens that may be incompatible to a host tissue system and vice versa.

In some embodiments, the methods described herein can be used to generate an autologous T cell expressing a CAR-T. In some embodiments, multiple base editing events can be accomplished in a single electroporation event, thereby reducing electroporation event associated toxicity. Any known methods for incorporation of exogenous genetic material into a cell may be used to replace electroporation, and such methods known in the art are hereby contemplated for use in any of the methods described herein.

In some embodiments, a subject having or having a propensity to develop a neoplasia (e.g., T- or NK-cell malignancy) is administered an effective amount of a modified immune effector cell (e.g., CAR-T cell) that lacks or has reduced levels of CD2 and expresses a CD2 chimeric antigen receptor containing a CD2 co-stimulatory domain. In some embodiments, the CD2 modified immune cell administered to a subject is further modified in one or more genes or regulatory elements (e.g., CD52, TRAC, PD-1) with the base editing compositions and methods provided herein.

As shown herein, base editing in combination with a CAR insertion is a useful strategy for generating fratricide resistant allogeneic T cells with minimal genomic rearrangements. Multiplex editing of genes may also be useful in the creation of CAR-T cell therapies with improved therapeutic properties. This method addresses known limitations of CAR-T therapy and is a promising development towards the next generation of precision cell based therapies.

In one experiment, the base editor BE4 demonstrated high efficiency multiplex base editing of three cell surface targets in T cells (TRAC, B2M, and PD-1), knocking out gene expression by 95%, 95% and 88%, respectively, in a single electroporation to generate cell populations with high percentages of cells with reduced protein expression of B2M and CD3. Editing each of these genes may be useful in the creation of CAR-T cell therapies with improved therapeutic properties. Each of the genes was silenced by a single targeted base change (C to T) without the creation of double strand breaks. As a result, the BE4-treated cells also did not show any measurable translocations (large-scale genomic rearrangements), whereas cells receiving the same three edits with a nuclease did show detectable genomic rearrangements.

Thus, coupling nuclease-based knockout of the TRAC gene with simultaneous BE-mediated knockout of two additional genes yields a homogeneous allogeneic T cell population with minimal genomic rearrangements, enabling the targeted insertion of a CAR transgene at the TRAC locus. Taken together, this demonstrates that base editing alone or in combination with a single nuclease knockout and CAR insertion is a useful strategy for generating allogeneic T cells with minimal genomic rearrangements compared to nuclease-alone approaches. This method addresses known limitations of multiplex-edited T cell products and are a promising development towards the next generation of precision cell based therapies.

Chimeric Antigen Receptor and CAR-T Cells

The invention provides immune cells modified using nucleobase editors described herein that express chimeric antigen receptors (CARs). Modification of immune cells to express a chimeric antigen receptor can enhance an immune cell's immunoreactive activity, wherein the chimeric antigen receptor has an affinity for an epitope on an antigen, wherein the antigen is associated with an altered fitness of an organism. For example, the chimeric antigen receptor can have an affinity for an epitope on a protein expressed in a neoplastic cell. Because the CAR-T cells can act independently of major histocompatibility complex (MHC), activated CAR-T cells can kill the neoplastic cell expressing the antigen. The direct action of the CAR-T cell evades neoplastic cell defensive mechanisms that have evolved in response to MHC presentation of antigens to immune cells.

In some embodiments, the invention provides immune effector cells that express chimeric antigen receptors that target B cells involved in an autoimmune response (e.g., B cells of a subject that express antibodies generated against the subject's own tissues).

Some embodiments comprise autologous immune cell immunotherapy, wherein immune cells are obtained from a subject having a disease or altered fitness characterized by cancerous or otherwise altered cells expressing a surface marker. The obtained immune cells are genetically modified to express a chimeric antigen receptor and are effectively redirected against specific antigens. Thus, in some embodiments, immune cells are obtained from a subject in need of CAR-T immunotherapy. In some embodiments, these autologous immune cells are cultured and modified shortly after they are obtained from the subject. In other embodiments, the autologous cells are obtained and then stored for future use. This practice may be advisable for individuals who may be undergoing parallel treatment that will diminish immune cell counts in the future. In allogeneic immune cell immunotherapy, immune cells can be obtained from a donor other than the subject who will be receiving treatment. In some embodiments, immune cells are obtained from a healthy subject or donor and are genetically modified to express a chimeric antigen receptor and are effectively redirected against specific antigens. The immune cells, after modification to express a chimeric antigen receptor, are administered to a subject for treating a neoplasia (e.g., leukemia). In some embodiments, immune cells to be modified to express a chimeric antigen receptor can be obtained from pre-existing stock cultures of immune cells.

Immune cells and/or immune effector cells can be isolated or purified from a sample collected from a subject or a donor using standard techniques known in the art. For example, immune effector cells can be isolated or purified from a whole blood sample by lysing red blood cells and removing peripheral mononuclear blood cells by centrifugation. The immune effector cells can be further isolated or purified using a selective purification method that isolates the immune effector cells based on cell-specific markers such as CD25, CD3, CD4, CD8, CD28, CD45RA, or CD45RO. In one embodiment, CD25+ is used as a marker to select regulatory T cells. In one embodiment, CD4$^+$ is used as a marker to select T cells. In one embodiment, CD8$^+$ is used as a marker to select T cells. In one embodiment, CD4$^+$ and CD8$^+$ are used as a marker to select T cells. In one embodiment, CD4$^+$ and CD25$^+$ are used as a marker to select T cells.

Figure 40:
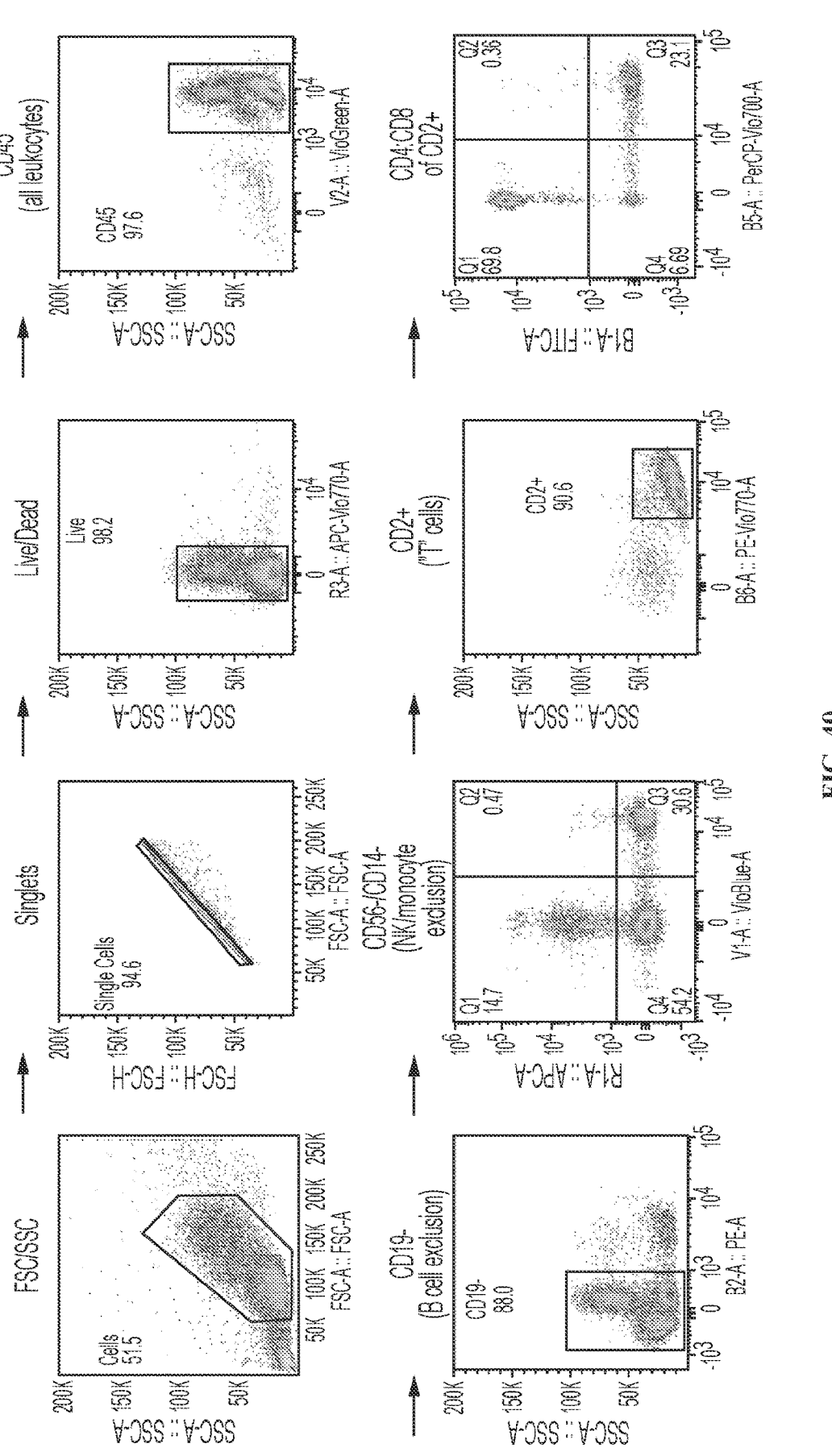
FIG. 40 depicts a gating scheme for an identity panel.

In another embodiment, the invention provides T cells that have targeted gene knockouts at the TCR constant region (TRAC), which is responsible for TCR$\alpha\beta$ surface expression. TCR$\alpha\beta$-deficient CAR T cells are compatible with allogeneic immunotherapy (Qasim et al., Sci. Transl. Med. 9, eaaj2013 (2017); Valton et al., Mol Ther. 2015 September; 23(9): 1507-1518). If desired, residual TCR$\alpha\beta$ T cells are removed using CliniMACS magnetic bead depletion to minimize the risk of GVHD. In another embodiment, the invention provides donor T cells selected ex vivo to recognize minor histocompatibility antigens expressed on recipient hematopoietic cells, thereby minimizing the risk of graft-versus-host disease (GVHD), which is the main cause of morbidity and mortality after transplantation (Warren et al., Blood 2010; 115(19):3869-3878). Another technique for isolating or purifying immune effector cells is flow cytometry. In fluorescence activated cell sorting a fluorescently labelled antibody with affinity for an immune effector cell marker is used to label immune effector cells in a sample. A gating strategy appropriate for the cells expressing the marker is used to segregate the cells. For example, T lymphocytes can be separated from other cells in a sample by using, for example, a fluorescently labeled antibody specific for an immune effector cell marker (e.g., CD4, CD8, CD28, CD45) and corresponding gating strategy. In one embodiment, a CD45 gating strategy is employed. In some embodiments, a gating strategy for other markers specific to an immune effector cell is employed instead of, or in combination with, the CD45 gating strategy. In one embodiment, a CD4 gating strategy is employed. In one embodiment, a CD8 gating strategy is employed. In one embodiment, a CD25 gating strategy is employed. In one embodiment, a CD4 and CD8 gating strategy is employed. In one embodiment, a CD4 and CD25 gating strategy is employed. In some embodiments, a gating strategy for other markers specific to an immune effector cell is employed instead of, or in combination with, the CD4, CD25 and/or CD8 gating strategy. In some embodiments, the gating strategy as provided in FIG. 40 is employed.

The immune effector cells contemplated in the invention are effector T cells. In some embodiments, the effector T cell is a naïve CD8$^+$ T cell, a cytotoxic T cell, a natural killer T (NKT) cell, a natural killer (NK) cell, or a regulatory T (Treg) cell. In some embodiments, the effector T cells are thymocytes, immature T lymphocytes, mature T lymphocytes, resting T lymphocytes, or activated T lymphocytes. In some embodiments the immune effector cell is a CD4$^+$ CD8+ T cell or a CD4$^-$ CD8$^-$ T cell. In some embodiments the immune effector cell is a T helper cell. In some embodiments the T helper cell is a T helper 1 (Th1), a T helper 2 (Th2) cell, or a helper T cell expressing CD4 (CD4+ T cell). In some embodiments, immune effector cells are effector NK cells. In some embodiments, the immune effector cell is any other subset of T cells. The modified immune effector cell may express, in addition to the chimeric antigen receptor, an exogenous cytokine, a different chimeric receptor, or any other agent that would enhance immune effector cell signaling or function. For example, co-expression of the chimeric antigen receptor and a cytokine may enhance the CAR-T cell's ability to lyse a target cell.

Chimeric antigen receptors as contemplated in the present invention comprise an extracellular binding domain, a transmembrane domain, and an intracellular domain. Binding of an antigen to the extracellular binding domain can activate the CAR-T cell and generate an effector response, which includes CAR-T cell proliferation, cytokine production, and other processes that lead to the death of the antigen express-ing cell. In some embodiments of the present invention, the chimeric antigen receptor further comprises a linker. In some embodiments, the linker is a (GGGGS)$_n$ linker (SEQ ID NO: 109). In some embodiments, the linker is a (GGGGS)$_3$ linker (SEQ ID NO: 110). In some embodiments, a CAR of the present invention includes a leader peptide sequence (e.g., N-terminal to the antigen binding domain). An exemplary leader peptide amino acid sequence is: METDTLLL-WVLLLWVPGSTG (SEQ ID NO: 55).

The extracellular binding domain of a chimeric antigen receptor contemplated herein comprises an amino acid sequence of an antibody, or an antigen binding fragment thereof, that has an affinity for a specific antigen. In various embodiments, the CAR specifically binds 5T4. Exemplary anti-5T4 CARs include, without limitation, CART-5T4 (Ox-ford BioMedica plc) and UCART-5T4 (Cellectis SA).

In various embodiments, the CAR specifically binds Alpha-fetoprotein. Exemplary anti-Alpha-fetoprotein CARs include, without limitation, ET-1402 (Eureka Therapeutics Inc).

In various embodiments, the CAR specifically binds Axl. Exemplary anti-Axl CARs include, without limitation, CCT-301-38 (F1 Oncology Inc).

In various embodiments, the CAR specifically binds B7H6. Exemplary anti-B7H6 CARs include, without limi-tation, CYAD-04 (Celyad SA).

In various embodiments, the CAR specifically binds BCMA. Exemplary anti-BCMA CARs include, without limitation, ACTR-087+SEA-BCMA (Seattle Genetics Inc), ALLO-715 (Cellectis SA), ARI-0002 (Institut d'Investigacions Biomediques August Pi I Sunyer), bb-2121 (bluebird bio Inc), bb-21217 (bluebird bio Inc), CART-BCMA (University of Pennsylvania), CT-053 (Carsgen Therapeutics Ltd), Descartes-08 (Cartesian Therapeutics), FCARH-143 (Juno Therapeutics Inc), ICTCAR-032 (Inno-vative Cellular Therapeutics Co Ltd), IM21 CART (Beijing Immunochina Medical Science & Technology Co Ltd), JCARH-125 (Memorial Sloan-Kettering Cancer Center), KITE-585 (Kite Pharma Inc), LCAR-B38M (Nanjing Leg-end Biotech Co Ltd), LCAR-B4822M (Nanjing Legend Biotech Co Ltd), MCARH-171 (Memorial Sloan-Kettering Cancer Center), P-BCMA-101 (Poseida Therapeutics Inc), P-BCMA-ALLO1 (Poseida Therapeutics Inc), spCART-269 (Shanghai Unicar-Therapy Bio-medicine Technology Co Ltd), and BCMA02/bb2121 (bluebird bio Inc). The poly-peptide sequence of the BCMA02/bb2121 CAR is provided below:

```
MALPVTALLLPLALLLHAARPDIVLTQSPPSLAMSLGKRATISCRASESV

TILGSHLIHWYQQKPGQPPTLLIQLASNVQTGVPARFSGSGSRTDFTLTI

DPVEEDDVAVYYCLQSRTIPRTFGGGTKLEIKGSTSGSGKPGSGEGSTKG

QIQLVQSGPELKKPGETVKISCKASGYTFTDYSINWVKRAPGKGLKWMGW

INTETREPAYAYDFRGRFAFSLETSASTAYLQINNLKYEDTATYFCALDY

SYAMDYWGQGTSVTVSSAAATTTPAPRPPTPAPTIASQPLSLRPEACRPA

AGGAVHTRGLDFACDIYIWAPLAGTCGVLLLSLVITLYCKRGRKKLLYIF

KQPFMRPVQTTQEEDGCSCRFPEEEEGGCELRVKFSRSADAPAYQQGQNQ
```

-continued
```
LYNELNLGRREEYDVLDKRRGRDPEMGGKPRRKNPQEGLYNELQKDKMAE

AYSEIGMKGERRRGKGHDGLYQGLSTATKDTYDALHMQALPPR
```

In various embodiments, the CAR specifically binds CCK2R. Exemplary anti-CCK2R CARs include, without limitation, anti-CCK2R CAR-T adaptor molecule (CAM)+ anti-FITC CAR T-cell therapy (cancer), Endocyte/Purdue (Purdue University), In various embodiments, the CAR specifically binds a CD antigen. Exemplary anti-CD antigen CARs include, without limitation, VM-802 (ViroMed Co Ltd).

In various embodiments, the CAR specifically binds CD123. Exemplary anti-CD123 CARs include, without limitation, MB-102 (Fortress Biotech Inc), RNA CART123 (University of Pennsylvania), SFG-iMC-CD123.zeta (Bel-licum Pharmaceuticals Inc), and UCART-123 (Cellectis SA).

In various embodiments, the CAR specifically binds CD133. Exemplary anti-CD133 CARs include, without limitation, KD-030 (Nanjing Kaedi Biotech Inc).

In various embodiments, the CAR specifically binds CD138. Exemplary anti-CD138 CARs include, without limitation, ATLCAR.CD138 (UNC Lineberger Comprehen-sive Cancer Center) and CART-138 (Chinese PLA General Hospital).

In various embodiments, the CAR specifically binds CD171. Exemplary anti-CD171 CARs include, without limitation, JCAR-023 (Juno Therapeutics Inc).

In various embodiments, the CAR specifically binds CD19. Exemplary anti-CD19 CARs include, without limi-tation, 1928z-41BBL (Memorial Sloan-Kettering Cancer Center), 1928z-E27 (Memorial Sloan-Kettering Cancer Center), 19-28z-T2 (Guangzhou Institutes of Biomedicine and Health), 4G7-CARD (University College London), 4SCAR19 (Shenzhen Geno-Immune Medical Institute), ALLO-501 (Pfizer Inc), ATA-190 (QIMR Berghofer Medi-cal Research Institute), AUTO-1 (University College Lon-don), AVA-008 (Avacta Ltd), axicabtagene ciloleucel (Kite Pharma Inc), BG-T19 (Guangzhou Bio-gene Technology Co Ltd), BinD-19 (Shenzhen BinDeBio Ltd.), BPX-401 (Bel-licum Pharmaceuticals Inc), CAR19h28TM41BBz (West-mead Institute for Medical Research), C-CAR-011 (Chinese PLA General Hospital), CDI9CART (Innovative Cellular Therapeutics Co Ltd), CIK-CAR.CD19 (Formula Pharma-ceuticals Inc), CLIC-1901 (Ottawa Hospital Research Insti-tute), CSG-CD19 (Carsgen Therapeutics Ltd), CTL-119 (University of Pennsylvania), CTX-101 (CRISPR Therapeu-tics AG), DSCAR-01 (Shanghai Hrain Biotechnology), ET-190 (Eureka Therapeutics Inc), FT-819 (Memorial Sloan-Kettering Cancer Center), ICAR-19 (Immune Cell Therapy Inc), IM19 CAR-T (Beijing Immunochina Medical Science & Technology Co Ltd), JCAR-014 (Juno Therapeu-tics Inc), JWCAR-029 (MingJu Therapeutics (Shanghai) Co., Ltd), KD-C-19 (Nanjing Kaedi Biotech Inc), Lin-CART19 (iCell Gene Therapeutics), lisocabtagene maraleu-cel (Juno Therapeutics Inc), MatchCART (Shanghai Hrain Biotechnology), MB-CART19.1 (Shanghai Children's Medical Center), PBCAR-0191 (Precision BioSciences Inc), PCAR-019 (PersonGen Biomedicine (Suzhou) Co Ltd), pCAR-19B (Chongqing Precision Biotech Co Ltd), PZ-01 (Pinze Lifetechnology Co Ltd), RB-1916 (Refuge Biotech-nologies Inc), SKLB-083019 (Chengdu Yinhe Biomedical Co Ltd), spCART-19 (Shanghai Unicar-Therapy Bio-medi-cine Technology Co Ltd), TBI-1501 (Takara Bio Inc), TC-110 (TCR2 Therapeutics Inc), TI-1007 (Timmune Biotech Inc), tisagenlecleucel (Abramson Cancer Center of the University of Pennsylvania), U-CART (Shanghai Bioray Laboratory Inc), UCART-19 (Wugen Inc), UCART-19 (Cellectis SA), vadacabtagene leraleucel (Memorial Sloan-Kettering Cancer Center), XLCART-001 (Nanjing Medical University), and yinnuokati-19 (Shenzhen Innovation Immunotechnology Co Ltd).

In various embodiments, the CAR specifically binds CD2. Exemplary anti-CD2 CARs include, without limitation, UCART-2 (Wugen Inc).

In various embodiments, the CAR specifically binds CD20. Exemplary anti-CD20 CARs include, without limitation, ACTR-087 (National University of Singapore), ACTR-707 (Unum Therapeutics Inc), CBM-C20.1 (Chinese PLA General Hospital), MB-106 (Fred Hutchinson Cancer Research Center), and MB-CART20.1 (Miltenyi Biotec GmbH).

In various embodiments, the CAR specifically binds CD22. Exemplary anti-CD22 CARs include, without limitation, anti-CD22 CAR T-cell therapy (B-cell acute lymphoblastic leukemia), University of Pennsylvania (University of Pennsylvania), CD22-CART (Shanghai Unicar-Therapy Bio-medicine Technology Co Ltd), JCAR-018 (Opus Bio Inc), MendCART (Shanghai Hrain Biotechnology), and UCART-22 (Cellectis SA).

In various embodiments, the CAR specifically binds CD30. Exemplary anti-CD30 CARs include, without limitation, ATLCAR.CD30 (UNC Lineberger Comprehensive Cancer Center), CBM-C30.1 (Chinese PLA General Hospital), and Hu30-CD28zeta (National Cancer Institute).

In various embodiments, the CAR specifically binds CD33. Exemplary anti-CD33 CARs include, without limitation, anti-CD33 CAR gamma delta T-cell therapy (acute myeloid leukemia), TC BioPharm/University College London (University College London), CAR33VH (Opus Bio Inc), CART-33 (Chinese PLA General Hospital), CIK-CAR.CD33 (Formula Pharmaceuticals Inc), UCART-33 (Cellectis SA), and VOR-33 (Columbia University).

In various embodiments, the CAR specifically binds CD38. Exemplary anti-CD38 CARs include, without limitation, UCART-38 (Cellectis SA).

In various embodiments, the CAR specifically binds CD38 A2. Exemplary anti-CD38 A2 CARs include, without limitation, T-007 (TNK Therapeutics Inc).

In various embodiments, the CAR specifically binds CD4. Exemplary anti-CD4 CARs include, without limitation, CD4CAR (iCell Gene Therapeutics).

In various embodiments, the CAR specifically binds CD44. Exemplary anti-CD44 CARs include, without limitation, CAR-CD44v6 (Istituto Scientifico H San Raffaele).

In various embodiments, the CAR specifically binds CD5. Exemplary anti-CD5 CARs include, without limitation, CD5CAR (iCell Gene Therapeutics). Exemplary CD5 CAR amino acid sequences are provided below:

```
>5CAR-CH3-CD28TM-CD28-CD3Z
  1 MEFGLSWLFLVAILKGVQCIDAMGNIQLVQSGPELKKPGETVKISCKASGYTFTNYGMNW 60

61 VKQAPGKGLRWMGWINTHTGEPTYADDFKGRFAFSLETSASTAYLQINNLKNEDTATYFC 120

121 TRRGYDWYFDVWGAGTTVTVSSGGGGSGGGGSGGGGSDIKMTQSPSSMYASLGERVTITC 180

181 KASQDINSYLSWFHHKPGKSPKTLIYRANRLVDGVPSRFSGSGSGQDYSLTISSLDYEDM 240

241 GIYYCQQYDESPWTFGGGTKLEMKGSGDPAEPKSPDKTHTCPGQPREPQVYTLPPSRDEL 300

301 TKNQVSLTCLVKGFYPSDIAVEWESNGQPENNYKTTPPVLDSDGSFFLYSKLTVDKSRWQ 360

361 QGNVFSCSVMHEALHNHYTQKSLSLSPGKKDPKFWVLVVVGGVLACYSLLVTVAFIIFWV 420

421 RSKRSRLLHSDYMNMTPRRPGPTRKHYQPYAPPRDFAAYRSRVKFSRSADAPAYQQGQNQ 480

481 LYNELNLGRREEYDVLDKRRGRDPEMGGKPRRKNPQEGLYNELQKDKMAEAYSEIGMKGE 540

541 RRRGKGHDGLYQGLSTATKDTYDALHMQALPPR                           573

>5CAR-CD8aH-CD28TM-CD28-CD3Z
  1 MEFGLSWLFLVAILKGVQCIDAMGNIQLVQSGPELKKPGETVKISCKASGYTFTNYGMNW 60

61 VKQAPGKGLRWMGWINTHTGEPTYADDFKGRFAFSLETSASTAYLQINNLKNEDTATYFC 120

121 TRRGYDWYFDVWGAGTTVTVSSGGGGSGGGGSGGGGSDIKMTQSPSSMYASLGERVTITC 180

181 KASQDINSYLSWFHHKPGKSPKTLIYRANRLVDGVPSRFSGSGSGQDYSLTISSLDYEDM 240

241 GIYYCQQYDESPWTFGGGTKLEMKGSGDPATTTPAPRPPTPAPTIASQPLSLRPEACRPA 300

301 AGGAVHTRGLDFACDFWVLVVVGGVLACYSLLVTVAFTIFWVRSKRSRLLHSDYMNMTPR 360

361 RPGPTRKHYQPYAPPRDFAAYRSRVKFSRSADAPAYQQGQNQLYNELNLGRREEYDVLDK 420

421 RRGRDPEMGGKPRRKNPQEGLYNELQKDKMAEAYSEIGMKGERRRGKGHDGLYQGLSTAT 480

481 KDTYDALHMQALPPR                                             495

>5CAR-CD28H-CD28TM-CD28-CD3Z
  1 MEFGLSWLFLVAILKGVQCIDAMGNIQLVQSGPELKKPGETVKISCKASGYTFTNYGMNW 60

61 VKQAPGKGLRWMGWINTHTGEPTYADDFKGRFAFSLETSASTAYLQINNLKNEDTATYFC 120

121 TRRGYDWYFDVWGAGTTVTVSSGGGGSGGGGSGGGGSDIKMTQSPSSMYASLGERVTITC 180
```

-continued

181 KASQDINSYLSWFHHKPGKSPKTLIYRANRLVDGVPSRFSGSGSGQDYSLTISSLDYEDM 240

241 GIYYCQQYDESPWTFGGGTKLEMKGSGDPAIEVMYPPPYLDNEKSNGTIIHVKGKHLCPS 300

301 PLFPGPSKPFWVLVVVGGVLACYSLLVTVAFIIFWVRSKRSRLLHSDYMNMTPRRPGPTR 360

361 KHYQPYAPPRDFAAYRSRVKFSRSADAPAYQQGQNQLYNELNLGRREEYDVLDKRRGRDP 420

421 EMGGKPRRKNPQEGLYNELQKDKMAEAYSEIGMKGERRRGKGHDGLYQGLSTATKDTYDA 480

481 LHMQALPPR 489

>5CAR-CH3-CD8aTM-41BB-CD3Z
  1 MEFGLSWLFLVAILKGVQCIDAMGNIQLVQSGPELKKPGETVKISCKASGYTFTNYGMNW 60

61 VKQAPGKGLRWMGWINTHTGEPTYADDFKGRFAFSLETSASTAYLQINNLKNEDTATYFC 120

121 TRRGYDWYFDVWGAGTTVTVSSGGGGSGGGGSGGGGSDIKMTQSPSSMYASLGERVTITC 180

181 KASQDINSYLSWFHHKPGKSPKTLIYRANRLVDGVPSRFSGSGSGQDYSLTISSLDYEDM 240

241 GIYYCQQYDESPWTFGGGTKLEMKGSGDPAEPKSPDKTHTCPGQPREPQVYTLPPSRDEL 300

301 TKNQVSLTCLVKGFYPSDIAVEWESNGQPENNYKTTPPVLDSDGSFFLYSKLTVDKSRWQ 360

361 QGNVFSCSVMHEALHNHYTQKSLSLSPGKKDPKPTTTPAPRPPTPAPTIASQPLSLRPEA 420

421 CRPAAGGAVHTRGLDFACDIYIWAPLAGTCGVLLLSLVITLYCKRGRKKLLYIFKQPFMR 480

481 PVQTTQEEDGCSCRFPEEEEGGCELRVKFSRSADAPAYQQGQNQLYNELNLGRREEYDVL 540

541 DKRRGRDPEMGGKPRRKNPQEGLYNELQKDKMAEAYSEIGMKGERRRGKGHDGLYQGLST 600

601 ATKDTYDALHMOALPPR 617

>5CAR-CD8aH-CD8aTM-41BB-CD3Z
  1 MEFGLSWLFLVAILKGVQCIDAMGNIQLVQSGPELKKPGETVKISCKASGYTFTNYGMNW 60

61 VKQAPGKGLRWMGWINTHTGEPTYADDFKGRFAFSLETSASTAYLQINNLKNEDTATYFC 120

121 TRRGYDWYFDVWGAGTTVTVSSGGGGSGGGGSGGGGSDIKMTQSPSSMYASLGERVTITC 180

181 KASQDINSYLSWFHHKPGKSPKTLIYRANRLVDGVPSRFSGSGSGQDYSLTISSLDYEDM 240

241 GIYYCQQYDESPWTFGGGTKLEMKGSGDPATTTPAPRPPTPAPTIASQPLSLRPEACRPA 300

301 AGGAVHTRGLDFACDIYIWAPLAGTCGVLLLSLVITLYCKRGRKKLLYIFKQPFMRPVQT 360

361 TQEEDGCSCRFPEEEEGGCELRVKFSRSADAPAYQQGQNQLYNELNLGRREEYDVLDKRR 420

421 GRDPEMGGKPRRKNPQEGLYNELQKDKMAEAYSEIGMKGERRRGKGHDGLYQGLSTATKD 480

481 TYDALHMQALPPRX 494

In various embodiments, the CAR specifically binds CD7. Exemplary anti-CD7 CARs include, without limitation, CAR-pNK (PersonGen Biomedicine (Suzhou) Co Ltd), and CD7.CAR/28zeta CAR T cells (Baylor College of Medicine), UCART7 (Washington University in St Louis). An exemplary CD7 CAR amino acid sequence is as follows:

>7CAR8
  1 MALPVTALLLPLALLLHAARPGSDIELTQSPAIMSASLGEEITLTCSASSSVSYMHWYQQ 60

61 KSGTSPKLLIYSTSNLASGVPSRFSGSGSGTFYSLTISSVEAEDAADYYCHQWSSYTFGG 120

121 GTKLEIKRGGGGSGGGGSGGGGSQVKLQESGGGLVKPGGSLKLSCAASGFTFSSYAMSWV 180

181 RQTPEKRLEWVATISSGGSYTYYPDSVKGRFTTSRDNAKNTLYLQMSSLRSEDTAMYYCA 240

241 RQDGYYPGWEANWGQGTTVTVSSAAATTTPAPRPPTPAPTLASQPLSLRPEACRPAAGGA 300

301 VHTRGLDFACDIYIWAPLAGTCGVLLLSLVITLYCRSKRSRLLHSDYMNMTPRRPGPTRK 360

361 HYQPYAPPRDFAAYRSRVKFSRSADAPAYQQGQNQLYNELNLGRREEYDVLDKRRGRDPE 420

421 MGGKPRRKNPQEGLYNELQKDKMAEAYSEIGMKGERRRGKGHDGLYQGLSTATKDTYDAL 480

481 HMQALPPR 488

In various embodiments, the CAR specifically binds CDH17. Exemplary anti-CDH17 CARs include, without limitation, ARB-001.T (Arbele Ltd).

In various embodiments, the CAR specifically binds CEA. Exemplary anti-CEA CARs include, without limitation, HORC-020 (HumOrigin Inc).

In various embodiments, the CAR specifically binds Chimeric TGF-beta receptor (CTBR). Exemplary anti-Chimeric TGF-beta receptor (CTBR) CARs include, without limitation, CAR-CTBR T cells (bluebird bio Inc).

In various embodiments, the CAR specifically binds Claudin18.2. Exemplary anti-Claudin18.2 CARs include, without limitation, CAR-CLD18 T-cells (Carsgen Therapeutics Ltd) and KD-022 (Nanjing Kaedi Biotech Inc).

In various embodiments, the CAR specifically binds CLL1. Exemplary anti-CLL1 CARs include, without limitation, KITE-796 (Kite Pharma Inc).

In various embodiments, the CAR specifically binds DLL3. Exemplary anti-DLL3 CARs include, without limitation, AMG-119 (Amgen Inc).

In various embodiments, the CAR specifically binds Dual BCMA/TACI (APRIL). Exemplary anti-Dual BCMA/TACI (APRIL) CARs include, without limitation, AUTO-2 (Autolus Therapeutics Limited).

In various embodiments, the CAR specifically binds Dual CD19/CD22. Exemplary anti-Dual CD19/CD22 CARs include, without limitation, AUTO-3 (Autolus Therapeutics Limited) and LCAR-L10D (Nanjing Legend Biotech Co Ltd).

In various embodiments, the CAR specifically binds CD19.

In various embodiments, the CAR specifically binds Dual CLL1/CD33. Exemplary anti-Dual CLL1/CD33 CARs include, without limitation, ICG-136 (iCell Gene Therapeutics).

In various embodiments, the CAR specifically binds Dual EpCAM/CD3. Exemplary anti-Dual EpCAM/CD3 CARs include, without limitation, IKT-701 (Icell Kealex Therapeutics).

In various embodiments, the CAR specifically binds Dual ErbB/4ab. Exemplary anti-Dual ErbB/4ab CARs include, without limitation, LEU-001 (King's College London).

In various embodiments, the CAR specifically binds Dual FAP/CD3. Exemplary anti-Dual FAP/CD3 CARs include, without limitation, IKT-702 (Icell Kealex Therapeutics).

In various embodiments, the CAR specifically binds EBV. Exemplary anti-EBV CARs include, without limitation, TT-18 (Tessa Therapeutics Pte Ltd).

In various embodiments, the CAR specifically binds EGFR. Exemplary anti-EGFR CARs include, without limitation, anti-EGFR CAR T-cell therapy (CBLB MegaTAL, cancer), bluebird bio (bluebird bio Inc), anti-EGFR CAR T-cell therapy expressing CTLA-4 checkpoint inhibitor+ PD-1 checkpoint inhibitor mAbs (EGFR-positive advanced solid tumors), Shanghai Cell Therapy Research Institute (Shanghai Cell Therapy Research Institute), CSG-EGFR (Carsgen Therapeutics Ltd), and EGFR-IL12-CART (Pregene (Shenzhen) Biotechnology Co Ltd).

In various embodiments, the CAR specifically binds EGFRvIII. Exemplary anti-EGFRvIII CARs include, without limitation, KD-035 (Nanjing Kaedi Biotech Inc) and UCART-EgfrVIII (Cellectis SA).

In various embodiments, the CAR specifically binds Flt3. Exemplary anti-Flt3 CARs include, without limitation, ALLO-819 (Pfizer Inc) and AMG-553 (Amgen Inc).

In various embodiments, the CAR specifically binds Folate receptor. Exemplary anti-Folate receptor CARs include, without limitation, EC17/CAR T (Endocyte Inc).

In various embodiments, the CAR specifically binds G250. Exemplary anti-G250 CARs include, without limitation, autologous T-lymphocyte cell therapy (G250-scFV-transduced, renal cell carcinoma), Erasmus Medical Center (Daniel den Hoed Cancer Center).

In various embodiments, the CAR specifically binds GD2. Exemplary anti-GD2 CARs include, without limitation, 1RG-CART (University College London), 4SCAR-GD2 (Shenzhen Geno-Immune Medical Institute), C7R-GD2.CART cells (Baylor College of Medicine), CMD-501 (Baylor College of Medicine), CSG-GD2 (Carsgen Therapeutics Ltd), GD2-CART01 (Bambino Gesu Hospital and Research Institute), GINAKIT cells (Baylor College of Medicine), iC9-GD2-CAR-IL-15 T-cells (UNC Lineberger Comprehensive Cancer Center), and IKT-703 (Icell Kealex Therapeutics).

In various embodiments, the CAR specifically binds GD2 and MUC1. Exemplary anti-GD2/MUC1 CARs include, without limitation, PSMA CAR-T (University of Pennsylvania).

In various embodiments, the CAR specifically binds GPC3. Exemplary anti-GPC3 CARs include, without limitation, ARB-002.T (Arbele Ltd), CSG-GPC3 (Carsgen Therapeutics Ltd), GLYCAR (Baylor College of Medicine), and TT-14 (Tessa Therapeutics Pte Ltd).

In various embodiments, the CAR specifically binds Her2. Exemplary anti-Her2 CARs include, without limitation, ACTR-087+trastuzumab (Unum Therapeutics Inc), ACTR-707+ trastuzumab (Unum Therapeutics Inc), CIDe-CAR (Bellicum Pharmaceuticals Inc), MB-103 (Mustang Bio Inc), RB-H21 (Refuge Biotechnologies Inc), and TT-16 (Baylor College of Medicine).

In various embodiments, the CAR specifically binds IL13R. Exemplary anti-IL13R CARs include, without limitation, MB-101 (City of Hope) and YYB-103 (YooYoung Pharmaceuticals Co Ltd).

In various embodiments, the CAR specifically binds integrin beta-7. Exemplary anti-integrin beta-7 CARs include, without limitation, MMG49 CAR T-cell therapy (Osaka University).

In various embodiments, the CAR specifically binds LC antigen. Exemplary anti-LC antigen CARs include, without limitation, VM-803 (ViroMed Co Ltd) and VM-804 (ViroMed Co Ltd).

In various embodiments, the CAR specifically binds mesothelin. Exemplary anti-mesothelin CARs include, without limitation, CARMA-hMeso (Johns Hopkins University), CSG-MESO (Carsgen Therapeutics Ltd), iCasp9M28z (Memorial Sloan-Kettering Cancer Center), KD-021 (Nanjing Kaedi Biotech Inc), m-28z-T2 (Guangzhou Institutes of Biomedicine and Health), MesoCART (University of Pennsylvania), meso-CAR-T+PD-78 (MirImmune LLC), RB-M1 (Refuge Biotechnologies Inc), and TC-210 (TCR2 Therapeutics Inc).

In various embodiments, the CAR specifically binds MUC1. Exemplary anti-MUC1 CARs include, without limitation, anti-MUC1 CAR T-cell therapy+PD-1 knockout T cell therapy (esophageal cancer/NSCLC), Guangzhou Anjie Biomedical Technology/University of Technology Sydney (Guangzhou Anjie Biomedical Technology Co LTD), ICT-CAR-043 (Innovative Cellular Therapeutics Co Ltd), ICT-CAR-046 (Innovative Cellular Therapeutics Co Ltd), P-MUCIC-101 (Poseida Therapeutics Inc), and TAB-28z (OncoTab Inc).

In various embodiments, the CAR specifically binds MUC16. Exemplary anti-MUC16 CARs include, without limitation, 4H1128Z-E27 (Eureka Therapeutics Inc) and JCAR-020 (Memorial Sloan-Kettering Cancer Center).

In various embodiments, the CAR specifically binds nfP2X7. Exemplary anti-nfP2X7 CARs include, without limitation, BIL-022c (Biosceptre International Ltd).

In various embodiments, the CAR specifically binds PSCA. Exemplary anti-PSCA CARs include, without limitation, BPX-601 (Bellicum Pharmaceuticals Inc).

In various embodiments, the CAR specifically binds PSMA. CIK-CAR.PSMA (Formula Pharmaceuticals Inc), and P-PSMA-101 (Poseida Therapeutics Inc).

In various embodiments, the CAR specifically binds ROR1. Exemplary anti-ROR1 CARs include, without limitation, JCAR-024 (Fred Hutchinson Cancer Research Center).

In various embodiments, the CAR specifically binds ROR2. Exemplary anti-ROR2 CARs include, without limitation, CCT-301-59 (F1 Oncology Inc).

In various embodiments, the CAR specifically binds SLAMF7. Exemplary anti-SLAMF7 CARs include, without limitation, UCART-CS1 (Cellectis SA).

In various embodiments, the CAR specifically binds TRBC1. Exemplary anti-TRBC1 CARs include, without limitation, AUTO-4 (Autolus Therapeutics Limited).

In various embodiments, the CAR specifically binds TRBC2. Exemplary anti-TRBC2 CARs include, without limitation, AUTO-5 (Autolus Therapeutics Limited).

In various embodiments, the CAR specifically binds TSHR. Exemplary anti-TSHR CARs include, without limitation, ICTCAT-023 (Innovative Cellular Therapeutics Co Ltd).

In various embodiments, the CAR specifically binds VEGFR-1. Exemplary anti-VEGFR-1 CARs include, without limitation, SKLB-083017 (Sichuan University).

In various embodiments, the CAR is AT-101 (AbClon Inc); AU-101, AU-105, and AU-180 (Aurora Biopharma Inc); CARMA-0508 (Carisma Therapeutics); CAR-T (Fate Therapeutics Inc); CAR-T (Cell Design Labs Inc); CM-CX1 (Celdara Medical LLC); CMD-502, CMD-503, and CMD-504 (Baylor College of Medicine); CSG-002 and CSG-005 (Carsgen Therapeutics Ltd); ET-1501, ET-1502, and ET-1504 (Eureka Therapeutics Inc); FT-61314 (Fate Therapeutics Inc); GB-7001 (Shanghai GeneChem Co Ltd); IMA-201 (Immatics Biotechnologies GmbH); IMM-005 and IMM-039 (Immunome Inc); ImmuniCAR (TC BioPharm Ltd); NT-0004 and NT-0009 (BioNTech Cell and Gene Therapies GmbH), OGD-203 (OGD2 Pharma SAS), PMC-005B (PharmAbcine), and TI-7007 (Timmune Biotech Inc).

Provided herein are also nucleic acids that encode the chimeric antigen receptors described herein. In some embodiments, the nucleic acid is isolated or purified. Delivery of the nucleic acids ex vivo can be accomplished using methods known in the art. For example, immune cells obtained from a subject may be transformed with a nucleic acid vector encoding the chimeric antigen receptor. The vector may then be used to transform recipient immune cells so that these cells will then express the chimeric antigen receptor. Efficient means of transforming immune cells include transfection and transduction. Such methods are well known in the art. For example, applicable methods for delivery the nucleic acid molecule encoding the chimeric antigen receptor (and the nucleic acid(s) encoding the base editor) can be found in International Application No. PCT/US2009/040040 and U.S. Pat. Nos. 8,450,112; 9,132,153; and 9,669,058, each of which is incorporated herein in its entirety. Additionally, those methods and vectors described herein for delivering the nucleic acid encoding the base editor are applicable to delivering the nucleic acid encoding the chimeric antigen receptor.

Extracellular Binding Domain

The chimeric antigen receptors of the invention include an extracellular binding domain. The extracellular binding domain of a chimeric antigen receptor contemplated herein comprises an amino acid sequence of an antibody, or an antigen binding fragment thereof, that has an affinity for a specific antigen. In some embodiments, the antigen is CD3. In some embodiments, the antigen is CD5. In some embodiments, the antigen is CD7. In some embodiments, the antigen is CD33. In some embodiments, the antigen is CD123.

In some embodiments the chimeric antigen receptor comprises an amino acid sequence of an antibody. In some embodiments, the chimeric antigen receptor comprises the amino acid sequence of an antigen binding fragment of an antibody. The antibody (or fragment thereof) portion of the extracellular binding domain recognizes and binds to an epitope of an antigen. In some embodiments, the antibody fragment portion of a chimeric antigen receptor is a single chain variable fragment (scFv). A scFv comprises the light and variable fragments of a monoclonal antibody. In other embodiments, the antibody fragment portion of a chimeric antigen receptor is a multichain variable fragment, which can comprise more than one extracellular binding domains and therefore bind to more than one antigen simultaneously. In a multiple chain variable fragment embodiment, a hinge region may separate the different variable fragments, providing necessary spatial arrangement and flexibility.

In other embodiments, the antibody portion of a chimeric antigen receptor comprises at least one heavy chain and at least one light chain. In some embodiments, the antibody portion of a chimeric antigen receptor comprises two heavy chains, joined by disulfide bridges and two light chains, wherein the light chains are each joined to one of the heavy chains by disulfide bridges. In some embodiments, the light chain comprises a constant region and a variable region. Complementarity determining regions residing in the variable region of an antibody are responsible for the antibody's affinity for a particular antigen. Thus, antibodies that recognize different antigens comprise different complementarity determining regions. Complementarity determining regions reside in the variable domains of the extracellular binding domain, and variable domains (i.e., the variable heavy and variable light) can be linked with a linker or, in some embodiments, with disulfide bridges. In some embodiments, the variable heavy chain and variable light chain are linked by a $(GGGGS)_n$ linker, wherein the n is an integer from 1 to 10 (SEQ ID NO: 114). In some embodiments, the linker is a $(GGGGS)_3$ linker (SEQ ID NO: 110).

In some embodiments, the antigen recognized and bound by the extracellular domain is a protein or peptide, a nucleic acid, a lipid, or a polysaccharide. Antigens can be heterologous, such as those expressed in a pathogenic bacteria or virus. Antigens can also be synthetic; for example, some individuals have extreme allergies to synthetic latex and exposure to this antigen can result in an extreme immune reaction. In some embodiments, the antigen is autologous, and is expressed on a diseased or otherwise altered cell. For example, in some embodiments, the antigen is expressed in a neoplastic cell. In some embodiments, the neoplastic cell is a solid tumor cell. In other embodiments, the neoplastic cell is a liquid tumor cell. In other embodiments, the neoplastic cell is a hematological cancer, such as a B cell cancer. In some embodiments, the B cell cancer is a lymphoma or a leukemia.

A liquid cancer to be treated with the methods described herein can be, for example, a leukemia. In some cases, the leukemia comprises a pre-leukemia. In some cases, the leukemia is an acute leukemia. Acute leukemias include, for example, an acute myeloid leukemia (AML). Acute leukemias also include, for example, an acute lymphoid leukemia or an acute lymphocytic leukemia (ALL); ALL includes B-lineage ALL; T-lineage ALL; and T-cell acute lymphocytic leukemia (T-ALL).

Nonlimiting examples of neoplasias include T-cell acute lymphoblastic leukemia (T-ALL), mycosis fungoides (MF), Sézary syndrome (SS), Peripheral T/NK-cell lymphoma, Anaplastic large cell lymphoma ALK$^+$, Primary cutaneous T-cell lymphoma, T-cell large granular lymphocytic leukemia, Angioimmunoblastic T/NK-cell lymphoma, Hepatosplenic T-cell lymphoma, Primary cutaneous CD30$^+$ T lymphoproliferative disorders, Extranodal NK/T-cell lymphoma, Adult T-cell leukemia/lymphoma, T-cell prolymphocytic leukemia, Subcutaneous panniculitis-like T-cell lymphoma, Primary cutaneous gamma-delta T-cell lymphoma, Aggressive NK-cell leukemia, and Enteropathy-associated T-cell lymphoma. In some embodiments, the neoplasia is T-cell acute lymphoblastic leukemia (T-ALL). In some embodiments, the neoplasia is acute myelogenous leukemia (AML).

Antibody-antigen interactions are noncovalent interactions resulting from hydrogen bonding, electrostatic or hydrophobic interactions, or from van der Waals forces. The affinity of extracellular binding domain of the chimeric antigen receptor for an antigen can be calculated with the following formula:

$$K_A = [\text{Antibody–Antigen}]/[\text{Antibody}][\text{Antigen}],$$
wherein

[Ab]=molar concentration of unoccupied binding sites on the antibody;

[Ag]=molar concentration of unoccupied binding sites on the antigen; and

[Ab–Ag]=molar concentration of the antibody-antigen complex.

The antibody-antigen interaction can also be characterized based on the dissociation of the antigen from the antibody. The dissociation constant ($K_D$) is the ratio of the association rate to the dissociation rate and is inversely proportional to the affinity constant. Thus, $K_D = 1/K_A$. Those skilled in the art will be familiar with these concepts and will know that traditional methods, such as ELISA assays, can be used to calculate these constants.

Transmembrane Domain

The chimeric antigen receptors of the invention include a transmembrane domain. The transmembrane domain of the chimeric antigen receptors described herein spans the CAR-T cells lipid bilayer cellular membrane and separates the extracellular binding domain and the intracellular signaling domain. In some embodiments, this domain is derived from other receptors having a transmembrane domain, while in other embodiments, this domain is synthetic. In some embodiments, the transmembrane domain may be derived from a non-human transmembrane domain and, in some embodiments, humanized. By "humanized" is meant having the sequence of the nucleic acid encoding the transmembrane domain optimized such that it is more reliably or efficiently expressed in a human subject. In some embodiments, the transmembrane domain is derived from another transmembrane protein expressed in a human immune effector cell. Examples of such proteins include, but are not limited to, subunits of the T cell receptor (TCR) complex, PDT, or any of the Cluster of Differentiation proteins, or other proteins, that are expressed in the immune effector cell and that have a transmembrane domain. In some embodiments, the transmembrane domain will be synthetic, and such sequences will comprise many hydrophobic residues.

Transmembrane domains for use in the disclosed CARs can include at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. In some embodiments, the transmembrane domain is derived from CD4, CD8α, CD28 or CD3ζ. In some embodiments, the transmembrane domain is a CD28 transmembrane domain. In some embodiments, the transmembrane domain is a CD8α transmembrane domain.

In some embodiments the transmembrane domain is a CD8α hinge and transmembrane domain. In some embodiments, the CD8α hinge and transmembrane domain is at least 85%, at least 90%, at least 95%, at least 98%, at least 99%, or 100% identical to an exemplary amino acid sequence as provided below:

```
SDPTTTPAPRPPTPAPTIASQPLSLRPEACRPAAGGAVHTRGLDFACDIY

TWAPLAGTCGVLLLSLVITLYC
```

The chimeric antigen receptor is designed, in some embodiments, to comprise a spacer between the transmembrane domain and the extracellular domain, the intracellular domain, or both. Such spacers can be 1, 2, 3, 4, 5, 6, 7, 8, 9, 10, 11, 12, 13, 14, 15, 16, 17, 18, 19, or 20 amino acids in length. In some embodiments, the spacer can be 20, 30, 40, 50, 60, 70, 80, 90, or 100 amino acids in length. In still other embodiments the spacer can be between 100 and 500 amino acids in length. The spacer can be any polypeptide that links one domain to another and are used to position such linked domains to enhance or optimize chimeric antigen receptor function. In some embodiments the hinge/spacer is selected from CH3, CD8α, or CD28.

Intracellular Signaling Domain

The chimeric antigen receptors of the invention include an intracellular signaling domain. The intracellular signaling domain is the intracellular portion of a protein expressed in a T cell that transduces a T cell effector function signal (e.g., an activation signal) and directs the T cell to perform a specialized function. T cell activation can be induced by a number of factors, including binding of cognate antigen to the T cell receptor on the surface of T cells and binding of cognate ligand to costimulatory molecules on the surface of the T cell. A T cell co-stimulatory molecule is a cognate binding partner on a T cell that specifically binds with a co-stimulatory ligand, thereby mediating a co-stimulatory response by the T cell, such as, but not limited to, proliferation. Co-stimulatory molecules include, but are not limited to an MHC class I molecule. Activation of a T cell leads to immune response, Such as T cell proliferation and differentiation (see, e.g., Smith-Garvin et al., Annu. Rev. Immunol., 27:591-619, 2009). Exemplary T cell signaling domains are known in the art. Non-limiting examples include the CD3ζ, CD8, CD28, CD27, CD154, GITR (TNFRSF18), CD134 (OX40), and CD137 (4-1BB) signaling domains.

The intracellular signaling domain of the chimeric antigen receptor contemplated herein comprises a primary signaling domain. In some embodiments, the chimeric antigen receptor comprises the primary signaling domain and a secondary, or co-stimulatory, signaling domain.

In some embodiments, the primary signaling domain comprises one or more immunoreceptor tyrosine-based activation motifs, or ITAMs. In some embodiments, the primary signaling domain comprises more than one ITAM. ITAMs incorporated into the chimeric antigen receptor may be derived from ITAMs from other cellular receptors. In some embodiments, the primary signaling domain comprising an ITAM may be derived from subunits of the TCR complex, such as CD3γ, CD3ε, CD3ζ, or CD3δ (see FIG. 1A). In some embodiments, the primary signaling domain comprising an ITAM may be derived from FcRγ, FcRβ, CD5, CD22, CD79a, CD79b, or CD66d.

In some embodiments, the primary signaling domain is selected from the group consisting of CD8, CD28, CD134 (OX40), CD137 (4-1BB), and CD3ζ. In some embodiments, the primary signaling domain is a CD3ζ signaling domain. In some embodiments, the CD3ζ signaling domain is at least 85%, at least 90%, at least 95%, at least 98%, at least 99%, or 100% identical to an exemplary amino acid sequence as provided below:

RVKFSRSADAPAYQQGQNQLYNELLLGRREEYDVLDKRRGRDPEMGGKPR

RKNPQEGLYNELQKDKMAEAYSEIGMKGERRRGKGHDGIYQGLSTATKDT

YDALHMQALPPR

In some embodiments, the primary signaling domain is a CD134 (OX40) signaling domain. In some embodiments, the CD134 (OX40) signaling domain is at least 85%, at least 90%, at least 95%, at least 98%, at least 99%, or 100% identical to an exemplary amino acid sequence as provided below:

RRDQRLPPDAHKPPGGGSFRTPIQEEQADAHSTLAKI

In some embodiments, the secondary, or co-stimulatory, signaling domain is derived from 4-1BB, CD2, CD4, CD28, CD5, CD8α, CD83, CD134, CD137, ICOS, or CD154. In some embodiments, the secondary signaling domain is a CD28 signaling domain. In some embodiments, the CD28 signaling domain is at least 85%, at least 90%, at least 95%, at least 98%, at least 99%, or 100% identical to an exemplary amino acid sequence as provided below:

SKRSRLLHSDYMNMTPRRPGPTRKHYQPYAPPRDFAAYRS

In some embodiments, the secondary signaling domain is a CD137 (4-1BB) signaling domain. In some embodiments, the CD137 (4-1BB) signaling domain is at least 85%, at least 90%, at least 95%, at least 98%, at least 99%, or 100% identical to an exemplary amino acid sequence as provided below:

KRGRKKLLYIFKQPFMRPVQTTQEEDGCSCRFPEEEEGGCEL

In some embodiments, the CD137 (4-1BB) signaling domain is at least 85%, at least 90%, at least 95%, at least 98%, at least 99%, or 100% identical to an exemplary amino acid sequence as provided below:

RFSVVKRGRKKLLYIFKQPFMRPVQTTQEEDGCSCRFPEEEEGGCEL.

In some embodiments, the CAR comprises one or more signaling domains. In some embodiments, the CAR comprises a 4-1BB signaling domain and a CD3(signaling domain. In some embodiments, the CAR comprises a CD28 signaling domain and a CD3(signaling domain.

Editing of Target Genes in Immune Cells

The present invention provides for immune cells comprising a chimeric antigen (CAR) and one or more edited genes, one or more regulatory elements thereof, or combinations thereof, wherein expression of the edited gene is either knocked out or knocked down. In some embodiments, the immune cell comprises a CAR and an altered endogenous gene that provides resistance to fratricide, enhances immune cell function, resistance to immunosuppression or inhibition, or a combination thereof. In some embodiments, the immune cell is a T cell. In some embodiments, the immune cell is a CAR-T cell. In some embodiments, the immune cell is a NK cell. In some embodiments, each edited gene may comprise a single base edit. In some embodiments, each edited gene may comprise multiple base edits at different regions of the gene.

In some embodiments, a single modification event (such as electroporation), may introduce one or more gene edits. In some embodiments at least one, two, three, four, five, six, seven, eight, nine, ten, eleven, twelve, thirteen, fourteen, fifteen, sixteen, seventeen, eighteen, nineteen, twenty or more edits may be introduced in one or more genes simultaneously. In some embodiments, an immune cell, including but not limited to any immune cell comprising an edited gene selected from any of the aforementioned gene edits, can be edited to generate mutations in other genes that enhance the CAR-T's function or reduce immunosuppression or inhibition of the cell.

In some embodiments, the CAR-T cells have increased fratricide resistance as compared to a similar CAR-T cell but without further having the one or more edited genes as described herein. In some embodiments, the CAR-T cells have reduced immunogenicity as compared to a similar CAR-T cell but without further having the one or more edited genes as described herein. In some embodiments, the CAR-T cells have lower activation threshold as compared to a similar CAR-T but without further having the one or more edited genes as described herein. In some embodiments, the CAR-T cells have increased anti-neoplasia activity as compared to a similar CAR-T cell but without further having the one or more edited genes as described herein.

In some embodiments, provided herein is an immune cell with at least one modification in an endogenous gene or regulatory elements thereof. In some embodiments, the immune cell may comprise a further modification in at least one, two, three, four, five, six, seven, eight, nine, ten, eleven, twelve, thirteen, fourteen, fifteen, sixteen, seventeen, eighteen, nineteen, twenty or more endogenous genes or regulatory elements thereof.

In some embodiments the one or more genes, or one or more regulatory elements thereof, or combinations thereof, may be selected from a group consisting of: CD3 antigen (CD3); CD5 antigen (CD5); CD7 antigen (CD7); CD33 antigen (CD33); CD52 antigen (CD52); CD123 antigen (CD123); T cell receptor alpha constant (TRAC); Programmed cell death 1 (PDCD1 or PD-1); Fas cell surface death receptor (FAS); Lymphocyte-activation gene 3 (LAG-3); Class II Major Histocompatibility Complex Transactivator (CIITA); T Cell Receptor Beta Constant 1 (TRBC1); T Cell Receptor Beta Constant 2 (TRBC2); and beta-2 microglobulin (B2M). In some embodiments, CD3, CD5, CD7, CD33 or CD123 is edited. In some embodiments, the immune cell comprises an edited CD3 gene, and additionally, at least one edited gene. In some embodiments, the immune cell comprises an edited CD5 gene, and additionally, at least one edited gene. In some embodiments, the immune cell comprises an edited CD7 gene, and additionally, at least one edited gene. In some embodiments, the immune cell comprises an edited CD33 gene, and additionally, at least one edited gene. In some embodiments, the immune cell comprises an edited CD123 gene, and additionally, at least one edited gene. The at least one edited gene may be selected from the list of genes mentioned in the preceding paragraphs. In some embodiments, CD3, CD5, CD7, CD33 or CD123 is edited in combination with one or more of TRAC, LAG-3, FAS, CIITA, TRBC1, TRBC2, CD52, B2M, and PD1.

In various embodiments, the modified immune cell comprises mutations in one or more of CD5, TRAC, LAG-3, FAS, CIITA, TRBC1, TRBC2, CD52, B2M, and PD1, or a combination thereof. In various embodiments, the modified immune cell comprises mutations in two, three, four, five, six, seven, eight, nine or ten of CD5, TRAC, LAG-3, FAS, CIITA, TRBC1, TRBC2, CD52, B2M, and PD1. In various embodiments, the modified immune cell comprises a mutation in CD5 and mutations in one or more of TRAC, LAG-3, FAS, CIITA, TRBC1, TRBC2, CD52, B2M, and PD1, or a combination thereof. In one embodiment, the modified immune cell comprises mutations in CD5, TRAC, LAG-3, FAS, CIITA, TRBC1, TRBC2, CD52, B2M, and PD1.

In various embodiments, the modified immune cell comprises mutations in one or more of CD7, TRAC, LAG-3, FAS, CIITA, TRBC1, TRBC2, CD52, B2M, and PD1, or a combination thereof. In various embodiments, the modified immune cell comprises mutations in two, three, four, five, six, seven, eight, nine or ten of CD7, TRAC, LAG-3, FAS, CIITA, TRBC1, TRBC2, CD52, B2M, and PD1. In various embodiments, the modified immune cell comprises a mutation in CD7 and mutations in one or more of TRAC, LAG-3, FAS, CIITA, TRBC1, TRBC2, CD52, B2M, and PD1, or a combination thereof. In one embodiment, the modified immune cell comprises mutations in CD7, TRAC, LAG-3, FAS, CIITA, TRBC1, TRBC2, CD52, B2M, and PD1.

In various embodiments, the modified immune cell comprises mutations in one or more of CD3, TRAC, LAG-3, FAS, CIITA, TRBC1, TRBC2, CD52, B2M, and PD1, or a combination thereof. In various embodiments, the modified immune cell comprises mutations in two, three, four, five, six, seven, eight, nine or ten of CD3, TRAC, LAG-3, FAS, CIITA, TRBC1, TRBC2, CD52, B2M, and PD1. In various embodiments, the modified immune cell comprises a mutation in CD3 and mutations in one or more of TRAC, LAG-3, FAS, CIITA, TRBC1, TRBC2, CD52, B2M, and PD1, or a combination thereof. In one embodiment, the modified immune cell comprises mutations in CD3, TRAC, LAG-3, FAS, CIITA, TRBC1, TRBC2, CD52, B2M, and PD1.

In various embodiments, the modified immune cell comprises mutations in one or more of CD33, TRAC, LAG-3, FAS, CIITA, TRBC1, TRBC2, CD52, B2M, and PD1, or a combination thereof. In various embodiments, the modified immune cell comprises mutations in two, three, four, five, six, seven, eight, nine or ten of CD33, TRAC, LAG-3, FAS, CIITA, TRBC1, TRBC2, CD52, B2M, and PD1. In various embodiments, the modified immune cell comprises a mutation in CD33 and mutations in one or more of TRAC, LAG-3, FAS, CIITA, TRBC1, TRBC2, CD52, B2M, and PD1, or a combination thereof. In one embodiment, the modified immune cell comprises mutations in CD33, TRAC, LAG-3, FAS, CIITA, TRBC1, TRBC2, CD52, B2M, and PD1.

In various embodiments, the modified immune cell comprises mutations in one or more of CD123, TRAC, LAG-3, FAS, CIITA, TRBC1, TRBC2, CD52, B2M, and PD1, or a combination thereof. In various embodiments, the modified immune cell comprises mutations in two, three, four, five, six, seven, eight, nine or ten of CD123, TRAC, LAG-3, FAS, CIITA, TRBC1, TRBC2, CD52, B2M, and PD1. In various embodiments, the modified immune cell comprises a mutation in CD123 and mutations in one or more of TRAC, LAG-3, FAS, CIITA, TRBC1, TRBC2, CD52, B2M, and PD1, or a combination thereof. In one embodiment, the modified immune cell comprises mutations in CD123, TRAC, LAG-3, FAS, CIITA, TRBC1, TRBC2, CD52, B2M, and PD1.

In some embodiments, the at least one modification is a single nucleobase modification. In some embodiments, the altered endogenous gene may be created by base editing. In some embodiments, the base editing may reduce or attenuate the gene expression. In some embodiments, the base editing may reduce or attenuate the gene activation. In some embodiments, the base editing may reduce or attenuate the functionality of the gene product. In some other embodiments, the base editing may activate or enhance the gene expression. In some embodiments, the base editing may increase the functionality of the gene product.

Allogeneic immune cells expressing an endogenous immune cell receptor as well as a chimeric antigen receptor may recognize and attack host cells, a circumstance termed graft versus host disease (GVHD). The alpha component of the immune cell receptor complex is encoded by the TRAC gene, and in some embodiments, this gene is edited such that the alpha subunit of the TCR complex is nonfunctional or absent. Because this subunit is necessary for endogenous immune cell signaling, editing this gene can reduce the risk of graft versus host disease caused by allogeneic immune cells.

In some embodiments, editing of genes to provide fratricide resistance, enhance the function of the immune cell or to reduce immunosuppression or inhibition can occur in the immune cell before the cell is transformed to express a chimeric antigen receptor. In other aspects, editing of genes to enhance the function of the immune cell or to reduce immunosuppression or inhibition can occur in a CAR-T cell, i.e., after the immune cell has been transformed to express a chimeric antigen receptor.

In some embodiments of the present invention, the CD5 gene is edited in the CAR-T cell to knockout or knockdown expression. The CAR-T is then transformed to express a chimeric antigen receptor with a CD5 scFv. By knocking out or knocking down expression of the CD5 gene, the modified CAR-T cells are less likely to commit fratricide.

In some embodiments of the present invention, the CD7 gene is edited in the CAR-T cell to knockout or knockdown expression. The CAR-T is then transformed to express a chimeric antigen receptor with a CD7 scFv. By knocking out or knocking down expression of the CD7 gene, the modified CAR-T cells are less likely to commit fratricide.

In some embodiments of the present invention, the CD33 gene is edited in the CAR-T cell to knockout or knockdown expression. The CAR-T is then transformed to express a chimeric antigen receptor with a CD33 scFv. By knocking out or knocking down expression of the CD33 gene, the modified CAR-T cells are less likely to commit fratricide.

In some embodiments of the present invention, the CD3 gene is edited in the CAR-T cell to knockout or knockdown expression. The CAR-T is then transformed to express a chimeric antigen receptor with a CD3 scFv. By knocking out or knocking down expression of the CD3 gene, the modified CAR-T cells are less likely to commit fratricide.

In some embodiments of the present invention, the CD123 gene is edited in the CAR-T cell to knockout or knockdown expression. The CAR-T is then transformed to express a chimeric antigen receptor with a CD123 scFv. By knocking out or knocking down expression of the CD123 gene, the modified CAR-T cells are less likely to commit fratricide.

Figure 1A:
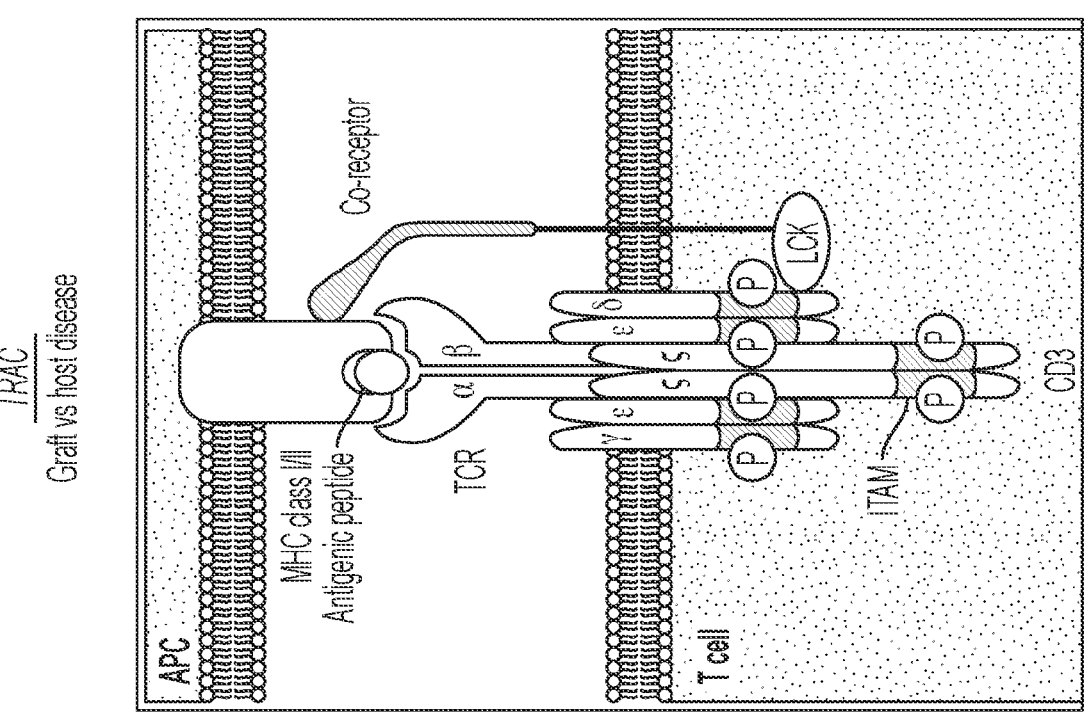

Host immune cells can potentially recognize allogeneic CAR-T cells as non-self and elicit an immune response to remove the non-self cells. B2M is expressed in nearly all nucleated cells and is associated with MHC class I complex (FIG. 1B). Circulating host CD8+ T cells can recognize this B2M protein as non-self and kill the allogeneic cells. To overcome this graft rejection, in some embodiments, the B2M gene is edited to either knockout or knockdown expression. In some embodiments, provided herein is an immune cell with an edited B2M gene, such that the immune cell does not express an endogenous functional B2M. In some embodiments, provided herein is a CAR-T cell with an edited B2M gene, such that the CAR-T cell exhibits reduced or negligible expression or no expression of endogenous B2M.

In some embodiments, an immune cell comprises a chimeric antigen receptor and one or more edited genes, a regulatory element thereof, or combinations thereof. An edited gene may be an immune response regulation gene, an immunogenic gene, a checkpoint inhibitor gene, a gene involved in immune responses, a cell surface marker, e.g. a T cell surface marker, or any combination thereof. In some embodiments, an immune cell comprises a chimeric antigen receptor and an edited gene that is associated with activated T cell proliferation, alpha-beta T cell activation, gamma-delta T cell activation, positive regulation of T cell proliferation, negative regulation of T-helper cell proliferation or differentiation, or their regulatory elements thereof, or combinations thereof. In some embodiments, the edited gene may be a checkpoint inhibitor gene, for example, such as a PD1 gene, a PDC1 gene, or a member related to or regulating the pathway of their formation or activation. In some embodiments, the edited gene is a TRAC gene. In some embodiments, the edited gene is a CD5 gene. In some embodiments, the edited gene is a CD7 gene. In some embodiments, the edited gene is a CD33 gene. In some embodiments, the edited gene is a CD3 gene. In some embodiments, the edited gene is a CD123 gene. In some embodiments, the edited gene is a B2M gene. In some embodiments, the edited gene is a CHTA gene. In some embodiments, the edited gene is a TRBC1/2 gene. In some embodiments, the edited gene is a CD5 gene. In some embodiments, the edited gene is a CD7 gene. In some embodiments, the edited gene is a CD52 gene. In some embodiments, at least one gene is edited selected from PD-1, CD2, CD3, CD5, CD7, CD52, B2M, TRBC12, CIITA, and TRAC, or combinations thereof. In some embodiments, the PD-1, CD2, CD52, and TRAC genes are edited. In some embodiments, the PD-1, CD2, CD52, B2M, TRBC1/2, CIITA and TRAC genes are edited. In some embodiments, the PD-1, CD5, CD52, and TRAC genes are edited. In some embodiments, the PD-1, CD3, CD7, and CD52 genes are edited.

In some embodiments, the editing of the endogenous gene reduces expression of the gene. In some embodiments, the editing of the endogenous gene reduces expression of the gene by at least 50% as compared to a control cell without the modification. In some embodiments, the editing of the endogenous gene reduces expression of the gene by at least 60% as compared to a control cell without the modification. In some embodiments, the editing of the endogenous gene reduces expression of the gene by at least 70% as compared to a control cell without the modification. In some embodiments, the editing of the endogenous gene reduces expression of the gene by at least 80% as compared to a control cell without the modification. In some embodiments, the editing of the endogenous gene reduces expression of the gene by at least 90% as compared to a control cell without the modification. In some embodiments, the editing of the endogenous gene reduces expression of the gene by at least 100% as compared to a control cell without the modification. In some embodiments, the editing of the endogenous gene eliminates gene expression.

In some embodiments of the present invention, the PDCD1 gene is edited in the CAR-T cell to knockout or knockdown expression. The PDCD1 gene encodes the cell surface receptor PD-1, an immune system checkpoint expressed in immune cells, and it is involved in reducing autoimmunity by promoting apoptosis of antigen specific immune cells. By knocking out or knocking down expression of the PDCD1 gene, the modified CAR-T cells are less likely to apoptose, are more likely to proliferate, and can escape the programmed cell death immune checkpoint.

Figure 1C:
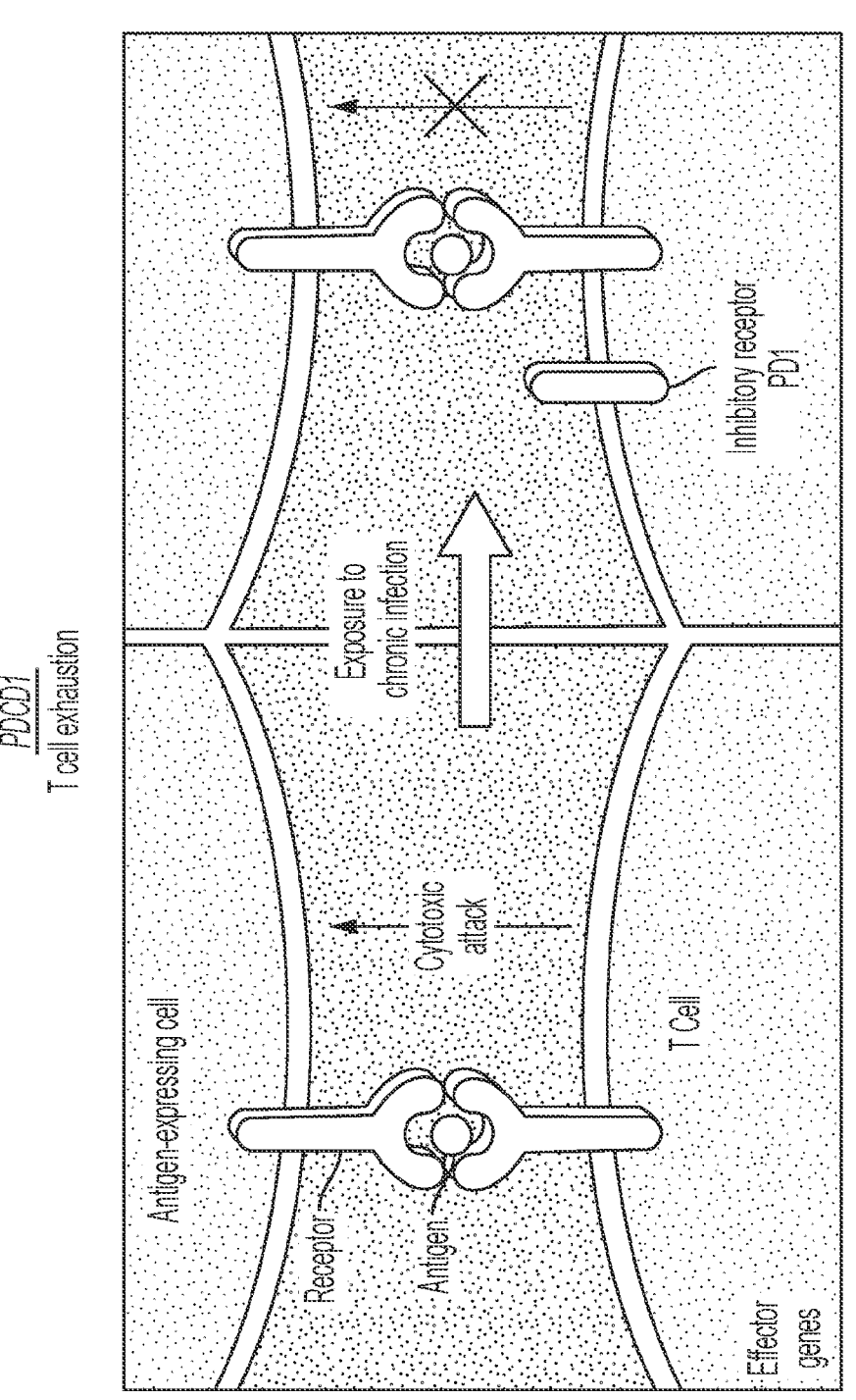
FIG. 1C is an illustration of T cell signaling that leads to expression of the PDCD1 gene, and the resulting PD-1 protein acts to inhibit the T cell signaling.

The CBLB gene encodes an E3 ubiquitin ligase that plays a significant role in inhibiting immune effector cell activation. Referring to FIG. 1C, the CBLB protein favors the signaling pathway resulting in immune effector cell tolerance and actively inhibits signaling that leads to immune effector cell activation. Because immune effector cell activation is necessary for the CAR-T cells to proliferate in vivo post-transplant, in some embodiments of the present invention the CBLB gene is edited to knockout or knockdown expression.

In some embodiments, provided herein is an immune cell with an edited TRAC gene (wherein, the TRAC gene may comprise one, two, three, four, five, six, seven eight, nine, ten or more base edits), such that the immune cell does not express an endogenous functional T cell receptor alpha chain. In some embodiments, the immune cell is a T cell expressing a chimeric antigen receptor (a CAR-T cell). In some embodiments, provided herein is a CAR-T cell with base edits in TRAC gene, such that the CAR-T cell have reduced or negligible or no expression of endogenous T cell receptor alpha protein.

In some embodiments, provided herein is an immune cell with an edited CIITA gene, such that the immune cell does not express an endogenous functional class II, major histocompatibility complex, transactivator. In some embodiments, provided herein is a CAR-T cell with an edited CIITA gene, such that the CAR-T cell exhibits reduced or negligible expression or no expression of endogenous class II, major histocompatibility complex, transactivator.

In some embodiments, provided herein is an immune cell with an edited TRBC1 or TRBC2 gene, such that the immune cell does not express an endogenous functional T cell receptor beta chain. In some embodiments, provided herein is a CAR-T cell with an edited TRBC1/TRBC2 gene, such that the CAR-T cell exhibits reduced or negligible expression or no expression of endogenous T cell receptor beta chain.

In some embodiments, an immune cell comprises a chimeric antigen receptor and an edited TRAC, B2M, PDCD1, CBLB gene, or a combination thereof, wherein expression of the edited gene is either knocked out or knocked down. In some embodiments, an immune cell comprises a chimeric antigen receptor and an edited TRAC gene, wherein expression of the edited gene is knocked out or knocked down. In some embodiments, an immune cell comprises a chimeric antigen receptor and edited TRAC and B2M genes, wherein expression of the edited genes is either knocked out or knocked down. In some embodiments, an immune cell comprises a chimeric antigen receptor and edited TRAC and PDCD1 genes, wherein expression of the edited genes is either knocked out or knocked down. In some embodiments, an immune cell comprises a chimeric antigen receptor and edited TRAC and CBLB genes, wherein expression of the edited genes is either knocked out or knocked down. In some embodiments, an immune cell comprises a chimeric antigen receptor and edited TRAC, B2M, and PDCD1 genes, wherein expression of the edited genes is either knocked out or knocked down. In some embodiments, an immune cell comprises a chimeric antigen receptor and edited TRAC, B2M, and CBLB genes, wherein expression of the edited genes is either knocked out or knocked down. In some embodiments, an immune cell or immune effector cell comprises a chimeric antigen receptor and edited TRAC, PDCD1, and CBLB genes, wherein expression of the edited genes is either knocked out or knocked down. In some embodiments, an immune cell comprises a chimeric antigen and edited TRAC, B2M, PDCD1, and CBLB genes, wherein expression of the edited genes is either knocked out or knocked down. In some embodiments, an immune cell comprises a chimeric antigen receptor and an edited B2M gene, wherein expression of the edited genes is either knocked out or knocked down. In some embodiments, an immune cell comprises a chimeric antigen receptor and edited B2M and PDCD1 genes, wherein expression of the edited genes is either knocked out or knocked down. In some embodiments, an immune cell comprises a chimeric antigen receptor and edited B2M and CBLB genes, wherein expression of the edited genes is either knocked out or knocked down. In some embodiments, an immune cell comprises a chimeric antigen receptor and edited B2M, PDCD1, and CBLB genes, wherein expression of the edited genes is either knocked out or knocked down. In some embodiments, an immune cell comprises a chimeric antigen receptor and an edited PDCD gene, wherein expression of the edited genes is either knocked out or knocked down. In some embodiments, an immune cell comprises a chimeric antigen receptor and edited PDCD and CBLB genes, wherein expression of the edited genes is either knocked out or knocked down. And in some embodiments, an immune cell comprises a chimeric antigen receptor and an edited CBLB, expression of the edited gene is either knocked out or knocked down.

In some embodiments, an immune cell comprises a chimeric antigen receptor and edited CD5 gene, wherein expression of the edited genes is either knocked out or knocked down. In some embodiments, an immune cell comprises a chimeric antigen receptor and edited CD7 gene, wherein expression of the edited genes is either knocked out or knocked down. In some embodiments, an immune cell comprises a chimeric antigen receptor and edited CD33 gene, wherein expression of the edited genes is either knocked out or knocked down. In some embodiments, an immune cell comprises a chimeric antigen receptor and edited CD3 gene, wherein expression of the edited genes is either knocked out or knocked down. In some embodiments, an immune cell comprises a chimeric antigen receptor and edited CD123 gene, wherein expression of the edited genes is either knocked out or knocked down. In some embodiments, an immune cell comprises a chimeric antigen receptor and edited FAS gene, wherein expression of the edited genes is either knocked out or knocked down. In some embodiments, an immune cell comprises a chimeric antigen receptor and edited LAG-3 gene, wherein expression of the edited genes is either knocked out or knocked down. In some embodiments, an immune cell comprises a chimeric antigen receptor and edited CIITA gene, wherein expression of the edited genes is either knocked out or knocked down. In some embodiments, an immune cell comprises a chimeric antigen receptor and edited TRBC1 gene, wherein expression of the edited genes is either knocked out or knocked down. In some embodiments, an immune cell comprises a chimeric antigen receptor and edited TRBC2 gene, wherein expression of the edited genes is either knocked out or knocked down. In some embodiments, an immune cell comprises a chimeric antigen receptor and edited CD52 gene, wherein expression of the edited genes is either knocked out or knocked down. In some embodiments, an immune cell comprises a chimeric antigen receptor and one or more edited CD3, CD5, CD7, CD33, CD123, TRAC, LAG-3, FAS, CIITA, TRBC1, TRBC2, CD52, B2M, and/or PD1 genes, wherein expression of the edited genes is either knocked out or knocked down.

The base editing may be positioned at any suitable position of the gene, or in a regulatory element of the gene. Thus, it may be appreciated that a single base editing at a start codon, for example, can completely abolish the expression of the gene. In some embodiments, the altered endogenous gene may be modified or edited in an exon, an intron, an exon-intron injunction, or a regulatory element thereof. The modification may be edit to a single nucleobase in a gene or a regulatory element thereof. The modification may be in a exon, more than one exons, an intron, or more than one introns, or a combination thereof. The modification may be in an open reading frame of a gene. The modification may be in an untranslated region of the gene, for example, a 3'-UTR or a 5'-UTR. In some embodiments, the modification is in a regulatory element of an endogenous gene. In some embodiments, the modification is in a promoter, an enhancer, an operator, a silencer, an insulator, a terminator, a transcription initiation sequence, a translation initiation sequence (e.g. a Kozak sequence), or any combination thereof. In some embodiments, base editing may introduce a premature STOP codon into an exon, resulting in either lack of a translated product or in a truncated that may be misfolded and thereby eliminated by degradation, or may produce an unstable mRNA that is readily degraded.

In some embodiments, base editing may be performed, for example on exon 1, exon 2, or exon 3, or exon 4, or exon 5 of human PDC1/PD-1 gene. In some embodiments, base editing in the human PDC1/PD-1 gene is performed at a site within exon 1. In some embodiments, base editing in the human PDC1/PD-1 gene is performed at a site within exon 2. In some embodiments, base editing in the human PDC1/PD-1 gene is performed at a site within exon 3. In some embodiments, base editing in the human PDC1/PD-1 gene is performed at a site within exon 4. In some embodiments, base editing in the human PDC1/PD-1 gene is performed at a site within exon 5. In some embodiments one or more base editing actions can be performed on the human PDC1/PD-1 gene, at exon 1, exon 2, exon 3, exon 4, exon 5, or any combination thereof.

In some embodiments, base editing in the human PDC1/PD-1A gene is performed by editing position 4, 6, 7, 8 or 9 of a guide RNA spacer sequence targeting exon 1. In some embodiments, base editing in the human PDC1/PD-1A gene is performed by editing position 4, 6, 7, 8 or 9 of a guide RNA spacer sequence targeting exon 1. In some embodiments, base editing in the human PDC1/PD-1A gene is performed by editing position 7, 8 or 9 of a guide RNA spacer sequence targeting exon 2. In some embodiments, base editing in the human PDC/PD-1A gene is performed by editing position 5, 7, or 8 of a guide RNA spacer sequence targeting exon 3. In some embodiments, base editing in the human PDC/PD-1A gene is performed by editing position 5 or 8 of a guide RNA spacer sequence targeting exon 5.

In some embodiments, base editing may be performed, for example on exon 1, exon 2, or exon 3 of human CD7 gene. In some embodiments, base editing in the human CD7 gene is performed at a site within exon 1. In some embodiments, base editing in the human CD7 gene is performed at a site within exon 2. In some embodiments, base editing in the human CD7 gene is performed at a site within exon 3. In some embodiments one or more base editing actions can be performed on the human CD7 gene, at exon 1, exon 2, exon 3, or any combination thereof. In some embodiments, base editing in the human CD7 gene is performed at position 4, 8, 9 within exon 1. In some embodiments, base editing in the human CD7 gene is performed by editing position 5, 6, 7, 8, or 9 of a guide RNA spacer sequence targeting exon 2. In some embodiments, base editing in the human CD7 gene is performed by editing position 4 or 9 of a guide RNA spacer sequence targeting exon 3.

In some embodiments, base editing may be performed, for example on exon 1, exon 2, exon 3, exon 4, exon 5, exon 6, exon 7, or exon 8 of human LAG-3 gene. In some embodiments, base editing in the human LAG-3 gene is performed at a site within exon 1. In some embodiments, base editing in the human LAG-3 gene is performed at a site within exon 2. In some embodiments, base editing in the human LAG-3 gene is performed at a site within exon 3. In some embodiments, base editing in the human LAG-3 gene is performed at a site within exon 4. In some embodiments, base editing in the human LAG-3 gene is performed at a site within exon 5. In some embodiments, base editing in the human LAG-3 gene is performed at a site within exon 6. In some embodiments, base editing in the human LAG-3 gene is performed at a site within exon 7. In some embodiments, base editing in the human LAG-3 gene is performed at a site within exon 8. In some embodiments one or more base editing actions can be performed on the human LAG-3 gene, at exon 1, exon 2, exon 3, exon 4, exon 5, exon 6, exon 7, exon 8, or any combination thereof. In some embodiments, base editing in the human LAG-3 gene is performed by editing position 4 or 8 of a guide RNA spacer sequence targeting exon 1. In some embodiments, base editing in the human LAG-3 gene is performed by editing position 4, 6, or 8 of a guide RNA spacer sequence targeting exon 2. In some embodiments, base editing in the human LAG-3 gene is performed by editing position 4, 5, 6 or 7 of a guide RNA spacer sequence targeting exon 3. In some embodiments, base editing in the human LAG-3 gene is performed by editing position 4, 8 or 9 of a guide RNA spacer sequence targeting exon 4. In some embodiments, base editing in the human LAG-3 gene is performed by editing position 8 or 9 of a guide RNA spacer sequence targeting exon 5. In some embodiments, base editing in the human LAG-3 gene is performed by editing position 4, 6, 7 or 8 of a guide RNA spacer sequence targeting exon 6. In some embodiments, base editing in the human LAG-3 gene is performed by editing position 4, 6 or 7 of a guide RNA spacer sequence targeting exon 7. In some embodiments, base editing in the human LAG-3 gene is performed by editing position 8 of a guide RNA spacer sequence targeting exon 8.

In some embodiments, base editing may be performed, for example on exon 1, exon 2, exon 3, exon 4, exon 5, or exon 6 of human CD33 gene. In some embodiments, base editing in the human CD33 gene is performed at a site within exon 1. In some embodiments, base editing in the human CD33 gene is performed at a site within exon 2. In some embodiments, base editing in the human CD33 gene is performed at a site within exon 3. In some embodiments, base editing in the human CD33 gene is performed at a site within exon 4. In some embodiments, base editing in the human CD33 gene is performed at a site within exon 5. In some embodiments, base editing in the human CD33 gene is performed at a site within exon 6. In some embodiments one or more base editing actions can be performed on the human CD33 gene, at exon 1, exon 2, exon 3, exon 4, exon 5, exon 6, or any combination thereof. In some embodiments, base editing in the human CD33 gene is performed by editing position 7, 8 or 9 of a guide RNA spacer sequence targeting exon 1. In some embodiments, base editing in the human CD33 gene is performed by editing position 4, 5, 6, or 8 of a guide RNA spacer sequence targeting exon 2. In some embodiments, base editing in the human CD33 gene is performed by editing position 4, 5, 6 or 7 of a guide RNA spacer sequence targeting exon 3. In some embodiments, base editing in the human CD33 gene is performed by editing position 6 or 7 of a guide RNA spacer sequence targeting exon 4. In some embodiments, base editing in the human CD33 gene is performed by editing position 7 or 8 of a guide RNA spacer sequence targeting exon 5. In some embodiments, base editing in the human CD33 gene is performed by editing position 4, 5, or 6 of a guide RNA spacer sequence targeting exon 6.

In some embodiments, base editing may be performed, for example on exon 1, exon 2, exon 3, exon 4, exon 5, exon 7, exon 8, exon 10, or exon 11 of human CD123 gene. In some embodiments, base editing in the human CD123 gene is performed at a site within exon 1. In some embodiments, base editing in the human CD123 gene is performed at a site within exon 2. In some embodiments, base editing in the human CD123 gene is performed at a site within exon 3. In some embodiments, base editing in the human CD123 gene is performed at a site within exon 4. In some embodiments, base editing in the human CD123 gene is performed at a site within exon 5. In some embodiments, base editing in the human CD123 gene is performed at a site within exon 7. In some embodiments, base editing in the human CD123 gene is performed at a site within exon 8. In some embodiments, base editing in the human CD123 gene is performed at a site within exon 10. In some embodiments, base editing in the human CD123 gene is performed at a site within exon 11. In some embodiments one or more base editing actions can be performed on the human CD123 gene, at exon 1, exon 2, exon 3, exon 4, exon 5, exon 7, exon 8, exon 10, exon 11, or any combination thereof. In some embodiments, base editing in the human CD123 gene is performed by editing position 6 of a guide RNA spacer sequence targeting exon 1. In some embodiments, base editing in the human CD123 gene is performed by editing position 4, 6, or 8 of a guide RNA spacer sequence targeting exon 2. In some embodiments, base editing in the human CD123 gene is performed by editing position 5, 6 or 8 of a guide RNA spacer sequence targeting exon 3. In some embodiments, base editing in the human CD123 gene is performed by editing position 5 or 6 of a guide RNA spacer sequence targeting exon 4. In some embodiments, base editing in the human CD123 gene is performed by editing position 4 or 5 of a guide RNA spacer sequence targeting exon 5. In some embodiments, base editing in the human CD123 gene is performed by editing position 5 of a guide RNA spacer sequence targeting exon 7. In some embodiments, base editing in the human CD123 gene is performed by editing position 5, 6, 7 or 8 of a guide RNA spacer sequence targeting exon 8. In some embodiments, base editing in the human CD123 gene is performed by editing position 4, 7 or 8 of a guide RNA spacer sequence targeting exon 10. In some embodiments, base editing in the human CD123 gene is performed by editing position 5 or 8 of a guide RNA spacer sequence targeting exon 11.

In some embodiments, base editing may be performed, for example on exon 1, or exon 3, or exon 4, or exon 5, or exon 6, or exon 7, or exon 8, or exon 9 of human FAS gene. In some embodiments, base editing in the human FAS gene is performed at a site within exon 1. In some embodiments, base editing in the human FAS gene is performed at a site within exon 3. In some embodiments, base editing in the human FAS gene is performed at a site within exon 4. In some embodiments, base editing in the human FAS gene is performed at a site within exon 5. In some embodiments, base editing in the human FAS is performed at a site within exon 6. In some embodiments, base editing in the human FAS is performed at a site within exon 7. In some embodiments, base editing in the human FAS is performed at a site within exon 8. In some embodiments, base editing in the human FAS is performed at a site within exon 9. In some embodiments one or more base editing actions can be performed on the human FAS gene, at exon 1, exon 3, exon 4, exon 5, exon 6, exon 7, exon 8, exon 9, or any combination thereof.

In some embodiments, base editing in the human FAS gene is performed by editing position 9 of a guide RNA spacer sequence targeting exon 1. In some embodiments, base editing in the human FAS gene is performed by editing position 6 of a guide RNA spacer sequence targeting exon 3. In some embodiments, base editing in the human FAS gene is performed by editing position 7 of a guide RNA spacer sequence targeting exon 4. In some embodiments, base editing in the human FAS gene is performed by editing position 5 of a guide RNA spacer sequence targeting exon 5. In some embodiments, base editing in the human FAS gene is performed by editing position 4 or 7 of a guide RNA spacer sequence targeting exon 6. In some embodiments, base editing in the human FAS gene is performed by editing position 8 of a guide RNA spacer sequence targeting exon 7. In some embodiments, base editing in the human FAS gene is performed by editing position 8 of a guide RNA spacer sequence targeting exon 8. In some embodiments, base editing in the human FAS gene is performed by editing position 5 or 6 of a guide RNA spacer sequence targeting exon 9.

In some embodiments, base editing may be performed, for example on exon 1, exon 2, or exon 3 of human CD52 gene. In some embodiments, base editing in the human CD52 gene is performed at a site within exon 1. In some embodiments, base editing in the human CD52 gene is performed at a site within exon 2. In some embodiments, base editing in the human CD7 gene is performed at a site within exon 3. In some embodiments one or more base editing actions can be performed on the human CD52 gene, at exon 1, exon 2, exon 3, or any combination thereof. In some embodiments, base editing in the human CD52 gene is performed by editing position 4 or 7 of a guide RNA spacer sequence targeting exon 1. In some embodiments, base editing in the human CD52 gene is performed by editing position 5, 6, or 7 of a guide RNA spacer sequence targeting exon 2.

In some embodiments, base editing may be performed, for example on exon 1, exon 2, or exon 3, or exon 4, or exon 5, or exon 6, or exon 7, or exon 8, or exon 9, or exon 10 of human CD5 gene. In some embodiments, base editing in the human CD5 gene is performed at a site within exon 1. In some embodiments, base editing in the human CD5 gene is performed at a site within exon 2. In some embodiments, base editing in the human CD5 gene is performed at a site within exon 3. In some embodiments, base editing in the human CD5 gene is performed at a site within exon 4. In some embodiments, base editing in the human CD5 gene is performed at a site within exon 5. In some embodiments, base editing in the human CD5 gene is performed at a site within exon 6. In some embodiments, base editing in the human CD5 gene is performed at a site within exon 7. In some embodiments, base editing in the human CD5 gene is performed at a site within exon 8. In some embodiments, base editing in the human CD5 gene is performed at a site within exon 9. In some embodiments, base editing in the human CD5 gene is performed at a site within exon 10. In some embodiments one or more base editing actions can be performed on the human CD5 gene, at exon 1, exon 2, exon 3, exon 4, exon 5, exon 6, exon 7, exon 8, exon 9, exon 10, or any combination thereof.

In some embodiments, base editing in the human CD5 gene is performed by editing position 6 of a guide RNA spacer sequence targeting exon 1. In some embodiments, base editing in the human CD5 gene is performed by editing position 6 of a guide RNA spacer sequence targeting exon 1. In some embodiments, base editing in the human CD5 gene is performed by editing position 5 and/or 6 of a guide RNA spacer sequence targeting exon 2. In some embodiments, base editing in the human CD5 gene is performed by editing position 5 and/or 6 of a guide RNA spacer sequence targeting exon 2. In some embodiments, base editing in the human CD5 gene is performed by editing position 5, 6, 8 and/or 9 of a guide RNA spacer sequence targeting exon 3. In some embodiments, base editing in the human CD5 gene is performed by editing position 4 or 5 of a guide RNA spacer sequence targeting exon 4. In some embodiments, base editing in the human CD5 gene is performed by editing position 4, 5, 7, 8 or 9 of a guide RNA spacer sequence targeting exon 5. In some embodiments, base editing in the human CD5 gene is performed by editing position 4, 5, 6, 7, 8 and/or 9 of a guide RNA spacer sequence targeting exon 6. In some embodiments, base editing in the human CD5 gene is performed by editing position 4 of a guide RNA spacer sequence targeting exon 7. In some embodiments, base editing in the human CD5 gene is performed by editing position 4, 5, or 7 of a guide RNA spacer sequence targeting exon 8. In some embodiments, base editing in the human CD5 gene is performed by editing position 6 or 8 of a guide RNA spacer sequence targeting exon 9. In some embodiments, base editing in the human CD5 gene is performed by editing position 9 of a guide RNA spacer sequence targeting exon 10.

In some embodiments, base editing may be performed, for example on exon 1, or exon 2, or exon 3 or exon 4 of human TRAC gene (UCSC genomic database ENSG00000277734.8). In some embodiments, base editing in human TRAC gene is performed at a site within exon 1. In some embodiments, base editing in human TRAC gene is performed at a site within exon 2. In some embodiments, base editing in human TRAC gene is performed at a site within exon 3. In some embodiments, base editing in human TRAC gene is performed at a site within exon 4. In some embodiments one or more base editing actions can be performed on human TRAC gene, at exon 1, exon 2, exon 3, exon 4 or any combination thereof. In some embodiments, base editing in the human TRAC gene is performed by editing at position 5, 6, or 9 of a guide RNA spacer sequence targeting within exon 1.

In some embodiments, base editing may be performed, for example, on exon 1, exon 2, exon 3, or exon 4 of human B2M gene (Chromosome 15, NC_000015.10, 44711492-44718877; exemplary mRNA sequence NM 004048). In some embodiments, base editing in human B2M gene is performed at a site within exon 1. In some embodiments, base editing in human B2M gene is performed at a site within exon 2. In some embodiments, base editing in human B2M gene is performed at a site within exon 3. In some embodiments, base editing in human B2M gene is performed at a site within exon 4. In some embodiments one or more base editing actions can be performed on human B2M gene, at exon 1, exon 2, exon 3, exon 4 or any combination thereof. In some embodiments, base editing in the human B2M gene is performed by editing position 5 of a guide RNA spacer sequence targeting exon 1. In some embodiments, base editing in the human B2M gene is performed by editing position 4, 6 or 9 of a guide RNA spacer sequence targeting exon 2.

In some embodiments, base editing may be performed, for example on exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, or exon 19 of human CIITA gene. In some embodiments, base editing in the human CD52 gene is performed at a site within exon 1. In some embodiments, base editing in the human CIITA gene is performed at a site within exon 2. In some embodiments, base editing in the human CIITA gene is performed at a site within exon 3. In some embodiments, base editing in the human CIITA gene is performed at a site within exon 4. In some embodiments, base editing in the human CIITA gene is performed at a site within exon 5. In some embodiments, base editing in the human CIITA gene is performed at a site within exon 6. In some embodiments, base editing in the human CIITA gene is performed at a site within exon 7. In some embodiments, base editing in the human CIITA gene is performed at a site within exon 8. In some embodiments, base editing in the human CIITA gene is performed at a site within exon 9. In some embodiments, base editing in the human CIITA gene is performed at a site within exon 10. In some embodiments, base editing in the human CIITA gene is performed at a site within exon 11. In some embodiments, base editing in the human CIITA gene is performed at a site within exon 12. In some embodiments, base editing in the human CIITA gene is performed at a site within exon 13. In some embodiments, base editing in the human CIITA gene is performed at a site within exon 14. In some embodiments, base editing in the human CIITA gene is performed at a site within exon 15. In some embodiments, base editing in the human CIITA gene is performed at a site within exon 16. In some embodiments, base editing in the human CIITA gene is performed at a site within exon 17. In some embodiments, base editing in the human CIITA gene is performed at a site within exon 18. In some embodiments, base editing in the human CIITA gene is performed at a site within exon 19. In some embodiments one or more base editing actions can be performed on the human CIITA gene, at exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, or any combination thereof.

In some embodiments, base editing in the human CIITA gene is performed by editing position 6 or 7 of a guide RNA spacer sequence targeting exon 1. In some embodiments, base editing in the human CIITA gene is performed by editing position 7 or 8 of a guide RNA spacer sequence targeting exon 2. In some embodiments, base editing in the human CIITA gene is performed by editing position 8 of a guide RNA spacer sequence targeting exon 4. In some embodiments, base editing in the human CIITA gene is performed by editing position 4, 7 or 8 of a guide RNA spacer sequence targeting exon 7. In some embodiments, base editing in the human CIITA gene is performed by editing position 8 of a guide RNA spacer sequence targeting exon 8. In some embodiments, base editing in the human CIITA gene is performed by editing position 4, 6, or 7 of a guide RNA spacer sequence targeting exon 9. In some embodiments, base editing in the human CIITA gene is performed by editing position 4, 5, or 7 of a guide RNA spacer sequence targeting exon 10. In some embodiments, base editing in the human CIITA gene is performed by editing position 4, 5, 6, 7 or 8 of a guide RNA spacer sequence targeting exon 11. In some embodiments, base editing in the human CIITA gene is performed by editing position 6 of a guide RNA spacer sequence targeting exon 12. In some embodiments, base editing in the human CIITA gene is performed by editing position 4 or 5 of a guide RNA spacer sequence targeting exon 14. In some embodiments, base editing in the human CIITA gene is performed by editing position 4, 7 or 8 of a guide RNA spacer sequence targeting exon 15. In some embodiments, base editing in the human CIITA gene is performed by editing position 5, 7 or 8 of a guide RNA spacer sequence targeting exon 16. In some embodiments, base editing in the human CIITA gene is performed by editing position 7 or 8 of a guide RNA spacer sequence targeting exon 17. In some embodiments, base editing in the human CIITA gene is performed by editing position 5 of a guide RNA spacer sequence targeting exon 18. In some embodiments, base editing in the human CIITA gene is performed by editing position 5, 6, 7 or 8 of a guide RNA spacer sequence targeting exon 19.

In some embodiments, base editing may be performed, for example, on exon 1, exon 2, or exon 3 of human TRBC1 gene. In some embodiments, base editing in human TRBC1 gene is performed at a site within exon 1. In some embodiments, base editing in human TRBC1 gene is performed at a site within exon 2. In some embodiments, base editing in human TRBC1 gene is performed at a site within exon 3. In some embodiments one or more base editing actions can be performed on human TRBC1 gene, at exon 1, exon 2, exon 3, or any combination thereof. In some embodiments, base editing in the human TRBC1 gene is performed by editing position 5, 6, 7 or 8 of a guide RNA spacer sequence targeting exon 1. In some embodiments, base editing in the human TRBC1 gene is performed by editing position 8 of a guide RNA spacer sequence targeting exon 2. In some embodiments, base editing in the human TRBC1 gene is performed by editing position 4 or 5 of a guide RNA spacer sequence targeting exon 3.

In some embodiments, base editing may be performed, for example, on exon 1, exon 2, or exon 3 of human TRBC2 gene. In some embodiments, base editing in human TRBC2 gene is performed at a site within exon 1. In some embodiments, base editing in human TRBC2 gene is performed at a site within exon 2. In some embodiments, base editing in human TRBC2 gene is performed at a site within exon 3. In some embodiments one or more base editing actions can be performed on human TRBC2 gene, at exon 1, exon 2, exon 3, or any combination thereof. In some embodiments, base editing in the human TRBC2 gene is performed by editing position 5, 6, 7 or 8 of a guide RNA spacer sequence targeting exon 1. In some embodiments, base editing in the human TRBC2 gene is performed by editing position 7 or 8 of a guide RNA spacer sequence targeting exon 2. In some embodiments, base editing in the human TRBC2 gene is performed by editing position 4 of a guide RNA spacer sequence targeting exon 3.

In some embodiments, base editing may be performed on an intron. For example, base editing may be performed on an intron. In some embodiments, the base editing may be performed at a site within an intron. In some embodiments, the base editing may be performed at a site one or more introns. In some embodiments, the base editing may be performed at any exon of the multiple introns in a gene. In some embodiments, one or more base editing may be performed on an exon, an intron or any combination of exons and introns.

In some embodiments, the modification or base edit may be within a promoter site. In some embodiments, the base edit may be introduced within an alternative promoter site. In some embodiments, the base edit may be in a 5' regulatory element, such as an enhancer. In some embodiment, base editing may be introduced to disrupt the binding site of a nucleic acid binding protein. Exemplary nucleic acid binding proteins may be a polymerase, nuclease, gyrase, topoisomerase, methylase or methyl transferase, transcription factors, enhancer, PABP, zinc finger proteins, among many others.

In some embodiments, base editing may be used for splice disruption to silence target protein expression. In some embodiments, base editing may generate a splice acceptor-splice donor (SA-SD) site. Targeted base editing generating a SA-SD, or at a SA-SD site can result in reduced expression of a gene. In some embodiments, base editors (e.g., ABE, CBE) are used to target dinucleotide motifs that constitute splice acceptor and splice donor sites, which are the first and last two nucleotides of each intron. For example, the exon 3 splice donor (SD) site of CD2 may be targeted for base editing. In some embodiments, splice disruption is achieved with an adenosine base editor (ABE). In some embodiments, splice disruption is achieved with a cytidine base editor (CBE). In some embodiments, base editors (e.g., ABE, CBE) are used to edit exons by creating STOP codons. The premature stop codon may be generated in an exon, an intron, or an untranslated region. In some embodiments, base editing may be used to introduce more than one STOP codon, in one or more alternative reading frames. For example, a premature STOP codon can be introduced at position 8 within exon 2, at position 4 within exon 3, at position 6 within exon 3, at position 9 within exon 3, at position 4 within exon 4, at position 5 within exon 4, or at position 4 within exon 5. In some embodiments, the stop codon is generated by a adenosine base editor (ABE). In some embodiments, the stop codon is generated by a cytidine base editor (CBE). In some embodiments, the CBE generates any one of the following edits (shown in underlined font) to generate a STOP codon: CAG→TAG; CAA→TAA; CGA→TGA; TGG→TGA; TGG→TAG; or TGG+TAA.

In some embodiments, modification/base edits may be introduced at a 3'-UTR, for example, in a poly adenylation (poly-A) site. In some embodiments, base editing may be performed on a 5'-UTR region.

In some embodiments, an immune cell, including by not limited to any immune cell comprising any of the aforementioned gene edits, can be edited to generate mutations in other genes that enhance the CAR-T's function or reduce immunosuppression or inhibition of the cell. For example, in some embodiments, an immune cell comprises a chimeric antigen receptor and an edited TGFBR2, ZAP70, NFATc1, TET2 gene, or a combination thereof, wherein expression of the edited gene is either knocked out or knocked down. In some embodiments, an immune cell comprises a chimeric antigen receptor and an edited TGFBR2 gene, wherein expression of the edited gene is knocked out or knocked down. In some embodiments, an immune cell comprises a chimeric antigen receptor and edited TGFBR2 and ZAP70 genes, wherein expression of the edited genes is either knocked out or knocked down. In some embodiments, an immune cell comprises a chimeric antigen receptor and edited TGFBR2 and ZAP70 genes, wherein expression of the edited genes is either knocked out or knocked down. In some embodiments, an immune cell comprises a chimeric antigen receptor and edited TGFBR2 and NFATC1 genes, wherein expression of the edited genes is either knocked out or knocked down. In some embodiments, an immune cell comprises a chimeric antigen receptor and edited TGFBR2 and TET2 genes, wherein expression of the edited genes is either knocked out or knocked down. In some embodiments, an immune cell comprises a chimeric antigen receptor and edited TGFBR2, ZAP70, and NFATC1 genes, wherein expression of the edited genes is either knocked out or knocked down. In some embodiments, an immune cell comprises a chimeric antigen receptor and edited TGFBR2, ZAP70, and TET2 genes, wherein expression of the edited genes is either knocked out or knocked down. In some embodiments, an immune cell comprises a chimeric antigen receptor and edited TGFBR2, NFATC1, and TET2 genes, wherein expression of the edited genes is either knocked out or knocked down. In some embodiments, an immune cell comprises a chimeric antigen and edited TGFBR2, ZAP70, NFATC1, and TET2 genes, wherein expression of the edited genes is either knocked out or knocked down. In some embodiments, an immune cell comprises a chimeric antigen receptor and an edited ZAP70 gene, wherein expression of the edited genes is either knocked out or knocked down. In some embodiments, an immune cell comprises a chimeric antigen receptor and edited ZAP70 and NFATC1 genes, wherein expression of the edited genes is either knocked out or knocked down. In some embodiments, an immune cell comprises a chimeric antigen receptor and edited ZAP70 and TET2 genes, wherein expression of the edited genes is either knocked out or knocked down. In some embodiments, an immune cell comprises a chimeric antigen receptor and edited ZAP70, PDCD1, and TET2 genes, wherein expression of the edited genes is either knocked out or knocked down. In some embodiments, an immune cell comprises a chimeric antigen receptor and an edited PDCD1 gene, wherein expression of the edited genes is either knocked out or knocked down. In some embodiments, an immune cell comprises a chimeric antigen receptor and edited PDCD1 and TET2 genes, wherein expression of the edited genes is either knocked out or knocked down. And in some embodiments, an immune cell comprises a chimeric antigen receptor and an edited TET2, expression of the edited gene is either knocked out or knocked down.

In some embodiments, a chimeric antigen receptor is inserted into the TRAC gene. This has advantages. First, because TRAC is highly expressed in immune cell, the chimeric antigen receptor will be similarly expressed when its construct is designed to insert the chimeric antigen receptor into the TRAC gene such that expression of the receptor is driven by the TRAC promoter. Second, inserting the chimeric antigen receptor into the TRAC gene will knockout TRAC expression. In some embodiments, the gene editing system described herein can be used to insert the chimeric antigen receptor into the TRAC locus. gRNAs specific for the TRAC locus can guide the gene editing system to the locus and initiate double-stranded DNA cleavage. In particular embodiments, the gRNA is used in conjunction with Cas12b. In various embodiments, the gene editing system is used in conjunction with a nucleic acid having a sequence encoding a CAR receptor. Exemplary guide RNAs are provided in the following Table 1A.

A DNA construct encoding the chimeric antigen receptor and nucleic acid containing extended stretches of TRAC DNA that flank the gRNA targeting sequences. Without being bound by theory, the construct binds to the complementary TRAC sequences, and the chimeric antigen receptor DNA, residing in proximity to the TRAC sequences on the construct is then inserted at the site of the lesion, effectively knocking out the TRAC gene and knocking in the chimeric antigen receptor nucleic acid. Table 1B provides guide RNAs for the TRAC gene that can guide the base editing machinery to the TRAC locus, which enables insertion of the chimeric antigen receptor nucleic acid. The first 11 gRNAs are for BhCas12b nuclease. The second set of 11 are for the BvCas12b nuclease. These are all for inserting the CAR at TRAC by creating a double stranded break, and not for base editing.

TABLE 1A

Guide RNAs

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 1
UUACGAGGCAUUAGCACAGAGUCUCUCAGCUGGUACAC             (Exon 2)

GUUCUGUCUUUUGGUCAGGACAACCGUCUAGCUAUAAGUG ATTN BhCas12b TRAC KO
CUGCAGGGUGUGAGGAAACUCCUAUUGCUGGACGAUGUUU      nuclease gRNA 2
CUUACGAGGCAUUAGCACACCGAUUUUGAUUCUCAAACA           (Exon 2)

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 3
UUACGAGGCAUUAGCACUCAAACAAAUGUGCACAAAG             (Exon 2)

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 4
UUACGAGGCAUUAGCACUCAAACAAAUGUGUCACAAAG            (Exon 2)

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 5
UUACGAGGCAUUAGCACUUUGAGAAUCAAAAUCGGUA             (Exon 2)

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 6
UUACGAGGCAUUAGCACUGAUGUGUAUAUCACAGACAA            (Exon 2)

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 7
UUACGAGGCAUUAGCAGUUGCUCCAGGCCACAGCAU              (Exon 2)

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 8
UUACGAGGCAUUAGCACUUCCAGAAGACACCUUCUUCC            (Exon 2)

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 9
UUACGAGGCAUUAGCACCAGAAGACACCUUCUUCCCCA            (Exon 2)

GUUCUGUCUUUUGGUCAGGACAACCGUCUAGCUAUAAGUG ATTN BhCas12b TRAC KO
CUGCAGGGUGUGAGAGAAACUCCUAUUGCUGGACGAUGUC      nuclease gRNA 10
UCUUACGAGGCAUUAGCACGGUUCCGAAUCCUCCUGA             (Exon 4)

GUUCUGUCUUUUGGUCAGGACAACCGUCUAGCUAUAAGUG ATTN BhCas12b TRAC KO
CUGCAGGGUGUGAGAAACUCCUAUUGCUGGACGAUGUCUC      nuclease gRNA 11
UUACGAGGCAUUAGCACGGAACCCAAUCACUGACAGGU            (Exon 4)

TABLE 1B

| Guide RNA | SEQ ID NO: | Gene | Exon |
|---|---|---|---|
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACAGAGTCTCTCAGCTGGTACA | 132 | TRAC gRNA | KO 1 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACACCGATTTTGATTCTCAAAC | 133 | TRAC gRNA | KO 2 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACTGATTCTCAAACAAATGTGT | 134 | TRAC gRNA | KO 3 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACTCAAACAAATGTGTCACAAA | 135 | TRAC gRNA | KO 4 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACGTTTGAGAATCAAAATCGGT | 136 | TRAC gRNA | KO 5 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACTGATGTGTATATCACAGACA | 137 | TRAC gRNA | KO 6 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACGTTGCTCCAGGCCACAGCAC | 138 | TRAC gRNA | KO 7 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACTTCCAGAAGACACCTTCTTC | 139 | TRAC gRNA | KO 8 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACCAGAAGACACCTTCTTCCCC | 140 | TRAC gRNA | KO 9 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACGGTTCCGAATCCTCCTCCTG | 141 | TRAC gRNA | KO 10 |
| GTTCTGTCTTTTGGTCAGGACAACCGTCTAGCTATAAGTGCTGCA GGGTGTGAGAAACTCCTATTGCTGGACGATGTCTCTTACGAGGCA TTAGCACGGAACCCAATCACTGACAGG | 142 | TRAC gRNA | KO 11 |
| GACCTATAGGGTCAATGAATCTGTGCGTGTGCCATAAGTAATTAA AAATTACCCACCACAGGAGCACCTGAAAACAGGTGCTTGGCACAG AGTCTCTCAGCTGGTACA | 143 | TRAC gRNA | KO 1 |
| GACCTATAGGGTCAATGAATCTGTGCGTGTGCCATAAGTAATTAA AAATTACCCACCACAGGAGCACCTGAAAACAGGTGCTTGGCACAC CGATTTTGATTCTCAAAC | 144 | TRAC gRNA | KO 2 |
| GACCTATAGGGTCAATGAATCTGTGCGTGTGCCATAAGTAATTAA AAATTACCCACCACAGGAGCACCTGAAAACAGGTGCTTGGCACTG ATTCTCAAACAAATGTGT | 145 | TRAC gRNA | KO 3 |
| GACCTATAGGGTCAATGAATCTGTGCGTGTGCCATAAGTAATTAAA AATTACCCACCACAGGAGCACCTGAAAACAGGTGCTTGGCACTCAA ACAAATGTGTCACAAA | 146 | TRAC gRNA | KO 4 |
| GACCTATAGGGTCAATGAATCTGTGCGTGTGCCATAAGTAATTAAA AATTACCCACCACAGGAGCACCTGAAAACAGGTGCTTGGCACGTTT GAGAATCAAAATCGGT | 147 | TRAC gRNA | KO 5 |
| GACCTATAGGGTCAATGAATCTGTGCGTGTGCCATAAGTAATTAAA AATTACCCACCACAGGAGCACCTGAAAACAGGTGCTTGGCACTGAT GTGTATATCACAGACA | 148 | TRAC gRNA | KO 6 |
| GACCTATAGGGTCAATGAATCTGTGCGTGTGCCATAAGTAATTAAA AATTACCCACCACAGGAGCACCTGAAAACAGGTGCTTGGCACGTTG CTCCAGGCCACAGCAC | 149 | TRAC gRNA | KO 7 |
| GACCTATAGGGTCAATGAATCTGTGCGTGTGCCATAAGTAATTAAA AATTACCCACCACAGGAGCACCTGAAAACAGGTGCTTGGCACTTCC AGAAGACACCTTCTTC | 150 | TRAC gRNA | KO 8 |

TABLE 1B-continued

| TRAC guide RNAs | | | |
|---|---|---|---|
| Guide RNA | SEQ ID NO: | Gene | Exon |
| GACCTATAGGGTCAATGAATCTGTGCGTGTGCCATAAGTAATTAAA AATTACCCACCACAGGAGCACCTGAAAACAGGTGCTTGGCACCAGA AGACACCTTCTTCCCC | 151 | TRAC gRNA 9 | KO |
| GACCTATAGGGTCAATGAATCTGTGCGTGTGCCATAAGTAATTAAA AATTACCCACCACAGGAGCACCTGAAAACAGGTGCTTGGCACGGTT CCGAATCCTCCTCCTG | 152 | TRAC gRNA 10 | KO |
| GACCTATAGGGTCAATGAATCTGTGCGTGTGCCATAAGTAATTAAA AATTACCCACCACAGGAGCACCTGAAAACAGGTGCTTGGCACGGAA CCCAATCACTGACAGG | 153 | TRAC gRNA 11 | KO |

First 11 gRNAs are for BhCas112b nuclease. Second set of 11 gRNAs are for the BvCas12b nuclease. Scaffold sequence in bold, in first instance.

In some embodiments, a nucleic acid encoding a chimeric antigen receptor of the present invention can be targeted to the TRAC locus using the BE4 base editor. In some embodiments, the chimeric antigen receptor is targeted to the TRAC locus using a CRISPR/Cas9 base editing system.

To produce the gene edits described above, immune cells are collected from a subject and contacted with two or more guide RNAs and a nucleobase editor polypeptide comprising a nucleic acid programmable DNA binding protein (napD-NAbp) and a cytidine deaminase or adenosine deaminase. In some embodiments, the collected immune cells are contacted with at least one nucleic acid, wherein the at least one nucleic acid encodes two or more guide RNAs and a nucleobase editor polypeptide comprising a nucleic acid programmable DNA binding protein (napDNAbp) and a cytidine deaminase. In some embodiments, the gRNA comprises nucleotide analogs. These nucleotide analogs can inhibit degradation of the gRNA from cellular processes. Table 2 provides target sequences to be used for gRNAs.

TABLE 2

| | | Exemplary Target Sequences | | | | |
|---|---|---|---|---|---|---|
| Target protein | Target residue | gRNA target | SEQ ID NO: | Base editor | Codon change | Residue function |
| NFATC1 | R118 | CTCGATGCGAGGACTCTCCA | 154 | BE | CGC>CAC | Calcineurin binding |
| | I119 | TCTCGATGCGAGGACTCTCC | 155 | ABE | ATC>ACC | Calcineurin binding |
| | E120 | CATCGAGATAACCTCGTGCT | 156 | ABE | GAG>GGG | Calcineurin binding |
| | S172 | TGGCCGGGCTCAGGCACGAG | 157 | BE | AGC>AAC | PHOSPHORYLATION |
| | W396 | GCCCACTGGTAGGGGTGCTG | 158 | ABE | TGG>CGG | Calcineurin binding |
| | R439 | TGGGCTCGGTGGTGGGACTT | 159 | BE | CGA>CAA | DNA BINDING |
| | H441 | CGAGCCCACTACGAGACGGA | 160 | ABE | CAC>CGC | DNA BINDING |
| | Y442 | CTCGTAGTGGGCTCGGTGGT | 161 | ABE | TAC>CAC | DNA BINDING |
| | K452 | GCCGTGAAGGCGTCGGCCGG | 162 | ABE | AAG>GGG | DNA BINDING |
| | R540 | GTTTCTGAGTTTCAGGATTC | 163 | BE | AGA>AAA | DNA BINDING |
| | R555 | CATCGGGAGGAAGAACACAC | 164 | ABE | AGG>GGG | DNA BINDING |
| | K556 | GGAGGAAGAACACACGGGTA | 165 | ABE | AAG>GGG | DNA BINDING |
| | Q589 | GAGCGCTGGGCTGCATCAGA | 166 | BE | CAG>CAT | DNA BINDING |
| NFATC2 | E114 | TGATCTCGATCCGAGGGCTC | 167 | BE | GAG>AAA | Calcineurin binding |
| | I115 | ACGGAGTGATCTCGATCCGA | 168 | ABE | ATC>ACC | Calcineurin binding |
| | R253 | GCCGAGGCATTCGTGCGCCG | 169 | ABE | AGG>GGG | NLS |
| | S99 | GCCGCGCTCAGAAACTTCTG | 170 | BE | AGC>AAC | PHOSPHORYLATION |
| | S107 | GGGCCTCGGGCCTGAGCCCT | 171 | BE | TCG>TTG | PHOSPHORYLATION |
| | S148 | CCTCGGGCTGGCGGCCACCC | 172 | BE | AGC>AAC | PHOSPHORYLATION |
| | S236 | CCACTCGCCCGTGCCCCGTC | 173 | BE | TCG>TTG | PHOSPHORYLATION |
| | S255 | GCATTCGTGCGCCGAGGCCT | 174 | BE | TCG>TTG | PHOSPHORYLATION |
| | S268 | GAGCCTCACCCCAGCGCTCC | 175 | BE | TCA>TTA | PHOSPHORYLATION |
| | S274 | GAGGGGCTCCGGGAGCGCTG | 176 | BE | AGC>AAC | PHOSPHORYLATION |
| | S326 | AGGGCTGGTCTTCCACATCT | 177 | BE | AGC>AAC | PHOSPHORYLATION |
| NFATC4 | S213 | GCGGGGAGCCCAGGCCAAAG | 178 | ABE | TCC>CCC | PHOSPHORYLATION |
| AKT1 | T305 | GCCACCATGAAGACCTTTTG | 179 | BE | ACC>ATT | PHOSPHORYLATION |
| | T312 | TTGCGGCACACCTGAGTACC | 180 | BE | ACA>ATA | PHOSPHORYLATION |
| | S473 | GTAGGAGAACTGGGGGAAGT | 181 | ABE | TCC>CCC | PHOSPHORYLATION |
| | Y474 | CTCCTACTCGGCCAGCGGCA | 182 | ABE | TAC>TGC | PHOSPHORYLATION |
| AKT2 | T309 | GAAAACCTTCTGTGGGACCC | 183 | BE | ACC>ATT | PHOSPHORYLATION |
| | S474 | AGTAGGAGAACTGGGGGAAG | 184 | ABE | TCC>CCC | PHOSPHORYLATION |
| BLIMP1 | C608 (ZF2) | GTTGCAAGTCTGACATTTGA | 185 | ABE | TGC>CGC | DNA BINDING |
| | C608 (ZF2) | GTTGCAAGTCTGACATTTGA | 185 | BE | TGC>TAC | DNA BINDING |
| | H621 (ZF2) | GAAACACTACCTGGTACACA | 186 | BE | CAC>TAT | DNA BINDING |
| | C636 (ZF3) | TGTGGCAGACCTACAGTGTA | 187 | BE | TGC>TAC | DNA BINDING |

TABLE 2-continued

Exemplary Target Sequences

| Target protein | Target residue | gRNA target | SEQ ID NO: | Base editor | Codon change | Residue function |
|---|---|---|---|---|---|---|
| | C664 (ZF4) | GGGCACACCTTGCATTGGTA | 188 | ABE | TGC>CGC | DNA BINDING |
| | Splice site 1 | CTGCGCACCTGGCATTCATG | 189 | BE | | |
| GCN2 kinase | Exon 1 SD | CCTACCGGTCCGCAAGCGTC | 190 | BE | | KNOCKOUT |
| (IDO | Exon 2 SD | ACTCACACATCTGGATAGGT | 191 | BE | | KNOCKOUT |
| pathway) | Exon 5 SD | GACTTACCTAGACCTTCCTG | 192 | BE | | KNOCKOUT |
| CBL-B | C373 | AATCTTACAGAGCTGAAAAG | 193 | BE | TGT>TAT | E3 UBIQUITIN LIGASE |
| | Y665.1 | CATCATATTCTTCACTTCCA | 194 | ABE | TAT>CAC | |
| | Y665.2 | AAGAATATGATGTTCCTCCC | 195 | ABE | TAT>TGT | |
| | K907 | CCCCTAAACCACGACCGCGC | 196 | ABE | AAA>GGG | |
| | R911 | TCCTGCGCGGTCGTGGTTTA | 197 | BE | CGC>CAC | |
| SHP1 | Y377 | CCCTACTCTGTGACCAACTG | 198 | ABE | TAC>TGC | |
| IRF4 | R96 | CGCAGGCGCGTCTTCCAGGT | 199 | BE | CGC>CAC | DNA BINDING |
| | R98 | GCACCGCAGGCGCGTCTTCC | 200 | BE | CGG>CAG | DNA BINDING |
| | K103 | GAACAAGAGCAATGACTTTG | 201 | ABE | AAG>GGG | DNA BINDING |
| PD1 | Exon 1 STOP | CACCTACCTAAGAACCATCC | 202 | BE | | KNOCKOUT |
| | Exon 2 STOP | GGGGTTCCAGGGCCTGTCTG | 203 | BE | | KNOCKOUT |
| TET2 | H1386 | GACTTGCACAACATGCAGAA | 204 | BE | CAC>TAC | DNA BINDING |
| | R1302 | TTGCCAGAAGCAAGATCCCA | 205 | ABE | AGA>GGG | DNA BINDING |
| | S1290 | CCATGAACAACCAAAAGAGA | 206 | ABE | TCA>CCA | DNA BINDING |
| SMARCA4 | T353 | TCACCCCCATCCAGAAGCCG | 207 | BE | ACC>ATT | PHOSPHORYLATION |
| | S610 | ATCTGGCTGGTCTCGTCCAG | 208 | BE | AGC>ATC | PHOSPHORYLATION |
| | S613 | GATGAGCGACCTCCCGGTGA | 209 | ABE | AGC>GGC | PHOSPHORYLATION |
| | S695 | AGACAGCGATGACGTCTCTG | 210 | ABE | AGC>GGC | PHOSPHORYLATION |
| | S699 | ACGTCTCTGAGGTGGACGCG | 211 | BE | TCT>TTT | PHOSPHORYLATION |
| | S1452 | TTAGGGGAGAGTTTCTCGGC | 212 | ABE | TCC>CCC | PHOSPHORYLATION |
| | S1575 | GGAGAGTGAGGAGGAGGAAG | 213 | ABE | AGT>GGT | PHOSPHORYLATION |
| | S1586 | AAGGCTCCGAATCCGAATCT | 214 | BE | TCC>TTT | PHOSPHORYLATION |
| | S1627 | ATCGTCACTCACGACCGGCT | 215 | BE | AGT>AAT | PHOSPHORYLATION |
| | S1631 | TGACAGTGAGGAGGAACAAG | 216 | ABE | AGT>GGT | PHOSPHORYLATION |
| CDK4 | P173 | CACCCGTGGTTGTTACACTC | 217 | BE | CCC>CTT | |
| ZAP70 | S144 | CATCAGCCAGGCCCCGCAGG | 218 | ABE | AGC>TGC | PHOSPHORYLATION |
| | Y292 | GGTGTATCCATCTGAGTTGA | 219 | ABE | TAC>CAC | PHOSPHORYLATION |
| | Y292 | GGGTGTATCCATCTGAGTTG | 220 | ABE | TAC>CAC | PHOSPHORYLATION |
| | R360 | GCGCAAGAAGCAGATCGACG | 221 | BE | CGC>TGC | Hypermorphic activity |
| | Y598 | TTACTACAGCCTGGCCAGCA | 222 | ABE | TAC>TGC | PHOSPHORYLATION |

The cytidine and adenosine deaminase nucleobase editors used in this invention can act on DNA, including single stranded DNA. Methods of using them to generate modifications in target nucleobase sequences in immune cells are presented.

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-methylated) strand opposite the targeted nucleobase. Mutation of the catalytic residue (e.g., D10 to A10) prevents cleavage of the edited strand containing the targeted A residue. Such Cas9 variants can generate a single-strand DNA break (nick) at a specific location based on the gRNA-defined target sequence, leading to repair of the non-edited strand, ultimately resulting in a nucleobase change on the non-edited strand.

Nucleobase Editors

Disclosed herein is a base editor or a nucleobase editor for editing, modifying or altering a target nucleotide sequence of a polynucleotide. Described herein is a nucleobase editor or a base editor comprising a polynucleotide programmable nucleotide binding domain and a nucleobase editing domain (e.g., adenosine deaminase or cytidine deaminase). A polynucleotide programmable nucleotide binding domain, when in conjunction with a bound guide polynucleotide (e.g., gRNA), can specifically bind to a target polynucleotide sequence (i.e., via complementary base pairing between bases of the bound guide nucleic acid and bases of the target polynucleotide sequence) and thereby localize the base editor to the target nucleic acid sequence desired to be edited. In some embodiments, the target polynucleotide sequence comprises single-stranded DNA or double-stranded DNA. In some embodiments, the target polynucleotide sequence comprises RNA. In some embodiments, the target polynucleotide sequence comprises a DNA-RNA hybrid.

Polynucleotide Programmable Nucleotide Binding Domain

It should be appreciated that polynucleotide programmable nucleotide binding domains can also include nucleic acid programmable proteins that bind RNA. For example, the polynucleotide programmable nucleotide binding domain can be associated with a nucleic acid that guides the polynucleotide programmable nucleotide binding domain to an RNA. Other nucleic acid programmable DNA binding proteins are also within the scope of this disclosure, though they are not specifically listed in this disclosure.

A polynucleotide programmable nucleotide binding domain of a base editor can itself comprise one or more domains. For example, a polynucleotide programmable nucleotide binding domain can comprise one or more nuclease domains. In some embodiments, the nuclease domain of a polynucleotide programmable nucleotide binding domain can comprise an endonuclease or an exonuclease. Herein the term "exonuclease" refers to a protein or polypeptide capable of digesting a nucleic acid (e.g., RNA or DNA) from free ends, and the term "endonuclease" refers to a protein or polypeptide capable of catalyzing (e.g., cleaving) internal regions in a nucleic acid (e.g., DNA or RNA). In some embodiments, an endonuclease can cleave a single strand of a double-stranded nucleic acid. In some embodiments, an endonuclease can cleave both strands of a double-stranded nucleic acid molecule. In some embodiments a polynucleotide programmable nucleotide binding domain can be a deoxyribonuclease. In some embodiments a polynucleotide programmable nucleotide binding domain can be a ribonuclease.

In some embodiments, a nuclease domain of a polynucleotide programmable nucleotide binding domain can cut zero, one, or two strands of a target polynucleotide. In some embodiments, the polynucleotide programmable nucleotide binding domain can comprise a nickase domain. Herein the term "nickase" refers to a polynucleotide programmable nucleotide binding domain comprising a nuclease domain that is capable of cleaving only one strand of the two strands in a duplexed nucleic acid molecule (e.g., DNA). In some embodiments, a nickase can be derived from a fully catalytically active (e.g., natural) form of a polynucleotide programmable nucleotide binding domain by introducing one or more mutations into the active polynucleotide programmable nucleotide binding domain. For example, where a polynucleotide programmable nucleotide binding domain comprises a nickase domain derived from Cas9, the Cas9-derived nickase domain can include a D10A mutation and a histidine at position 840. In such embodiments, the residue H840 retains catalytic activity and can thereby cleave a single strand of the nucleic acid duplex. In another example, a Cas9-derived nickase domain can comprise an H840A mutation, while the amino acid residue at position 10 remains a D. In some embodiments, a nickase can be derived from a fully catalytically active (e.g., natural) form of a polynucleotide programmable nucleotide binding domain by removing all or a portion of a nuclease domain that is not required for the nickase activity. For example, where a polynucleotide programmable nucleotide binding domain comprises a nickase domain derived from Cas9, the Cas9-derived nickase domain can comprise a deletion of all or a portion of the RuvC domain or the HNH domain.

The amino acid sequence of an exemplary catalytically active Cas9 is as follows:

```
MDKKYSIGLDIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV
```

-continued
ILADANLDKVLSAYNKHRDKPIREQAENIIHLFTLTNLGAPAAFKYFDTTIDRKRYTSTKEVLD

ATLIHQSITGLYETRIDLSQLGGD.

A base editor comprising a polynucleotide programmable nucleotide binding domain comprising a nickase domain is thus able to generate a single-strand DNA break (nick) at a specific polynucleotide target sequence (e.g., determined by the complementary sequence of a bound guide nucleic acid). In some embodiments, the strand of a nucleic acid duplex target polynucleotide sequence that is cleaved by a base editor comprising a nickase domain (e.g., Cas9-derived nickase domain) is the strand that is not edited by the base editor (i.e., the strand that is cleaved by the base editor is opposite to a strand comprising a base to be edited). In other embodiments, a base editor comprising a nickase domain (e.g., Cas9-derived nickase domain) can cleave the strand of a DNA molecule which is being targeted for editing. In such embodiments, the non-targeted strand is not cleaved.

Also provided herein are base editors comprising a poly-nucleotide programmable nucleotide binding domain which is catalytically dead (i.e., incapable of cleaving a target polynucleotide sequence). Herein the terms "catalytically dead" and "nuclease dead" are used interchangeably to refer to a polynucleotide programmable nucleotide binding domain which has one or more mutations and/or deletions resulting in its inability to cleave a strand of a nucleic acid. In some embodiments, a catalytically dead polynucleotide programmable nucleotide binding domain base editor can lack nuclease activity as a result of specific point mutations in one or more nuclease domains. For example, in the case of a base editor comprising a Cas9 domain, the Cas9 can comprise both a D10A mutation and an H840A mutation. Such mutations inactivate both nuclease domains, thereby resulting in the loss of nuclease activity. In other embodiments, a catalytically dead polynucleotide programmable nucleotide binding domain can comprise one or more deletions of all or a portion of a catalytic domain (e.g., RuvC1 and/or HNH domains). In further embodiments, a catalytically dead polynucleotide programmable nucleotide binding domain comprises a point mutation (e.g., D10A or H840A) as well as a deletion of all or a portion of a nuclease domain.

Also contemplated herein are mutations capable of generating a catalytically dead polynucleotide programmable nucleotide binding domain from a previously functional version of the polynucleotide programmable nucleotide binding domain. For example, in the case of catalytically dead Cas9 ("dCas9"), variants having mutations other than D10A and H840A are provided, which result in nuclease inactivated Cas9. Such mutations, by way of example, include other amino acid substitutions at D10 and H840, or other substitutions within the nuclease domains of Cas9 (e.g., substitutions in the HNH nuclease subdomain and/or the RuvC1 subdomain). Additional suitable nuclease-inactive dCas9 domains can be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

Non-limiting examples of a polynucleotide program-mable nucleotide binding domain which can be incorporated into a base editor include a CRISPR protein-derived domain, a restriction nuclease, a meganuclease, TAL nuclease (TALEN), and a zinc finger nuclease (ZFN). In some embodiments, a base editor comprises a polynucleotide programmable nucleotide binding domain comprising a natural or modified protein or portion thereof which via a bound guide nucleic acid is capable of binding to a nucleic acid sequence during CRISPR (i.e., Clustered Regularly Interspaced Short Palindromic Repeats)-mediated modification of a nucleic acid. Such a protein is referred to herein as a "CRISPR protein." Accordingly, disclosed herein is a base editor comprising a polynucleotide programmable nucleo-tide binding domain comprising all or a portion of a CRISPR protein (i.e. a base editor comprising as a domain all or a portion of a CRISPR protein, also referred to as a "CRISPR protein-derived domain" of the base editor). A CRISPR protein-derived domain incorporated into a base editor can be modified compared to a wild-type or natural version of the CRISPR protein. For example, as described below a CRISPR protein-derived domain can comprise one or more mutations, insertions, deletions, rearrangements and/or recombinations relative to a wild-type or natural version of the CRISPR protein.

CRISPR is an adaptive immune system that provides protection against mobile genetic elements (viruses, trans-posable elements and conjugative plasmids). CRISPR clus-ters contain spacers, sequences complementary to anteced-ent mobile elements, and target invading nucleic acids. CRISPR clusters are transcribed and processed into CRISPR RNA (crRNA). In type II CRISPR systems, correct process-ing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or cir-cular dsDNA target complementary to the spacer. The target strand not complementary to crRNA is first cut endonucle-olytically, and then trimmed 3'-5' exonucleolytically. In nature, DNA-binding and cleavage typically requires protein and both RNAs. However, single guide RNAs ("sgRNA," or simply "gRNA") can be engineered so as to incorporate aspects of both the crRNA and tracrRNA into a single RNA species. See, e.g., Jinek M., et al. Science 337:816-821 (2012), the entire contents of which is hereby incorporated by reference. Cas9 recognizes a short motif in the CRISPR repeat sequences (the PAM or protospacer adjacent motif) to help distinguish self versus non-self.

In some embodiments, the methods described herein can utilize an engineered Cas protein. A guide RNA (gRNA) is a short synthetic RNA composed of a scaffold sequence necessary for Cas-binding and a user-defined ~20 nucleotide spacer that defines the genomic target to be modified. Thus, a skilled artisan can change the genomic target of the Cas protein specificity is partially determined by how specific the gRNA targeting sequence is for the genomic target compared to the rest of the genome.

In some embodiments, the gRNA scaffold sequence is as follows:

GUUUUAGAGCUAGAAAUAGCAAGUUAAAAUAAGGCUAGUCCGUUAUCAA
CUUGAAAAAGUGGCACCGAGUCGGUGCUUUU.

In an embodiment, the RNA scaffold comprises a stem loop. In an embodiment, the RNA scaffold comprises the nucleic acid sequence:

GUUUUUGUACUCUCAAGAUUUAAGUAACUGUACAACGAAACUUACACAG
UUACUUAAAUCUUGCAGAAGCUACAAAGAUAAGGCUUCAUGCCGAAAUC
AACACCCUGUCAUUUUAUGGCAGGGUG.

In an embodiment, the RNA scaffold comprises a canonical stem loop. In an embodiment, the RNA scaffold comprises the nucleic acid sequence:

GUUUUAGAGCUAGAAAUAGCAAGUUAAAAUAAGGCUAGUCCGUUAUCAA
CUUGAAAAAGUGGCACCGAGUCGGUGCU*mU*mU*mU where m=2'-O-methyl modification and *=3' phosphorothioate internucleotide linkages (i.e., at the first 3' terminal RNA residues as shown here).

In an embodiment, the RNA scaffold comprises the nucleic acid sequence:

GUUUUAGAGCUAGAAAUAGCAAGUUAAAAUAAGGCUAGUCCGUUAUCAA
CUUGAAAAAGUGGCACCGAGUCGGUGCUUUU where m=2'-O-methyl modification and *=3' phosphorothioate internucleotide linkages (i.e., at the first 3' terminal RNA residues as shown here).

In an embodiment, an *S. pyogenes* sgRNA scaffold polynucleotide sequence is as follows:

GUUUUAGAGCUAGAAAUAGCAAGUUAAAAUAAGGCUAGUCCGUUAUCAA
CUUGAAAAAGUGGCACCGAGUCGGUGC.

In an embodiment, an *S. aureus* sgRNA scaffold polynucleotide sequence is as follows:

GUUUUAGUACUCUGUAAUGAAAAUUACAGAAUCUACUAAAACAAGGCAA
AAUGCCGUGUUUAUCUCGUCAACUUGUUGGCGAGA.

In an embodiment, a BhCas12b sgRNA scaffold has the following polynucleotide sequence:

GUUCUGUCUUUUGGUCAGGACAACCGUCUAGCUAUAAGUGCUGCAGGGU
GUGAGAAACUCCUAUUGCUGGACGAUGUCUCUUACGAGGCAUUAGCAC.

In an embodiment, a BvCas12b sgRNA scaffold has the following polynucleotide sequence:

GACCUAUAGGGUCAAUGAAUCUGUGCGUGUGCCAUAAGUAAUUAAAAAU
UACCCACCACAGGAGCACCUGAAAACAGGUGCUUGGCAC.

In an embodiment, the RNA scaffold comprises a noncanonical sequence. In an embodiment, the RNA scaffold comprises the nucleic acid sequence:

GUUUUAGAGCUAGAAAUAGCAAGUUAAAAUAAGGCUAGUCCGUUAUCAA
CUUGAAAAAGUGGGACCGAGUCGGUGCU*mU*mU*mU where m=2'-O-methyl modification and *=3' phosphorothioate internucleotide linkages (i.e., at the first 3' terminal RNA residues as shown here).

In some embodiments, a CRISPR protein-derived domain incorporated into a base editor is an endonuclease (e.g., deoxyribonuclease or ribonuclease) capable of binding a target polynucleotide when in conjunction with a bound guide nucleic acid. In some embodiments, a CRISPR protein-derived domain incorporated into a base editor is a nickase capable of binding a target polynucleotide when in conjunction with a bound guide nucleic acid. In some embodiments, a CRISPR protein-derived domain incorporated into a base editor is a catalytically dead domain capable of binding a target polynucleotide when in conjunction with a bound guide nucleic acid. In some embodiments, a target polynucleotide bound by a CRISPR protein derived domain of a base editor is DNA. In some embodiments, a target polynucleotide bound by a CRISPR protein-derived domain of a base editor is RNA.

Cas proteins that can be used herein include class 1 and class 2. Non-limiting examples of Cas proteins include Cas1, Cas1B, Cas2, Cas3, Cas4, Cas5, Cas5d, Cas5t, Cas5h, Cas5a, Cas6, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, Cas12a/Cpf1, Cas12b/C2c1, Cas12c/C2c3, Cas12d/CasY, Cas12e/CasX, Cas12g, Cas12h, Cas12i, and Cas12j/CasΦ, CARF, DinG, homologues thereof, or modified versions thereof. An unmodified CRISPR enzyme can have DNA cleavage activity, such as Cas9, which has two functional endonuclease domains: RuvC and HNH. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence.

A vector that encodes a CRISPR enzyme that is mutated to with respect, to a corresponding wild-type enzyme such that the mutated CRISPR enzyme lacks the ability to cleave one or both strands of a target polynucleotide containing a target sequence can be used. Cas9 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild-type exemplary Cas9 polypeptide (e.g., Cas9 from *S. pyogenes*). Cas9 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild-type exemplary Cas9 polypeptide (e.g., from *S. pyogenes*). Cas9 can refer to the wild-type or a modified form of the Cas9 protein that can comprise an amino acid change such as a deletion, insertion, substitution, variant, mutation, fusion, chimera, or any combination thereof.

In some embodiments, a CRISPR protein-derived domain of a base editor can include all or a portion of Cas9 from *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref:

NC_021846.1); *Streptococcus iniae* (NCBI Ref: NC_021314.1); *Belliella baltica* (NCBI Ref: NC_018010.1); *Psychroflexus torquis* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); *Neisseria meningitidis* (NCBI Ref: YP_002342100.1), *Streptococcus pyogenes*, or *Staphylococcus aureus*.

Cas9 Domains of Nucleobase Editors

Cas9 nuclease sequences and structures are well known to those of skill in the art (See, e.g., "Complete genome sequence of an Ml strain of *Streptococcus pyogenes*." Ferretti et al., Proc. Natl. Acad. Sci. U.S.A. 98:4658-4663 (2001); "CRISPR RNA maturation by trans-encoded small RNA and host factor RNase III." Deltcheva E., et al., Nature 471:602-607(2011); and "A programmable dual-RNA-guided DNA endonuclease in adaptive bacterial immunity." Jinek M., et al., Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

In some embodiments, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain (dCas9), or a Cas9 nickase (nCas9). In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1,2,3,4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), Cas12a/Cpf1, Cas12b/C2cl, Cas12c/C2c3, Cas12d/CasY, Cas12e/CasX, Cas12g, Cas12h, Cas12i, and Cas12j/CasΦ. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2cl, Cas12c/C2c3, Cas12d/CasY, Cas12e/CasX, Cas12g, Cas12h, Cas12i, Cas12j/CasΦ, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof.

In some embodiments, wild-type Cas9 corresponds to Cas9 from *Streptococcus pyogenes* (NCBI Reference Sequence: NC_017053.1). An exemplary *Streptococcus pyogenes* Cas9 (spCas9) nucleic acid sequence is provided below:

```
ATGGATAAGAAATACTCAATAGGCTTAGATATCGGCACAAATAGCGTCGGATGGGCGGTGATCA

CTGATGATTATAAGGTTCCGTCTAAAAAGTTCAAGGTTCTGGGAAATACAGACCGCCACAGTAT

CAAAAAAAATCTTATAGGGGCTCTTTTATTTGGCAGTGGAGAGACAGCGGAAGCGACTCGTCTC

AAACGGACAGCTCGTAGAAGGTATACACGTCGGAAGAATCGTATTTGTTATCTACAGGAGATTT

TTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTAT

CATGAGAAATATCCAACTATCTATCATCTGCGAAAAAAATTGGCAGATTCTACTGATAAAGCGG

ATTTGCGCTTAATCTATTTGGCCTTAGCGCATATGATTAAGTTTCGTGGTCATTTTTTGATTGA

GGGAGATTTAAATCCTGATAATAGTGATGTGGACAAACTATTTATCCAGTTGGTACAAATCTAC

AATCAATTATTTGAAGAAAACCCTATTAACGCAAGTAGAGTAGATGCTAAAGCGATTCTTTCTG

CACGATTGAGTAAATCAAGACGATTAGAAAATCTCATTGCTGAGCTCCCCGGTGAGAAGAGAAA

TGGCTTGTTTGGGAATCTCATTGCTTTGTCATTGGGATTGACCCCTAATTTTAAATCAAATTTT

GATTTGGCAGAAGATGCTAAATTACAGCTTTCAAAAGATACTTACGATGATGATTTAGATAATT

TATTGGCGCAAATTGGAGATCAATATGCTGATTTGTTTTTGGCAGCTAAGAATTTATCAGATGC

TATTTTACTTTCAGATATCCTAAGAGTAAATAGTGAAATAACTAAGGCTCCCCTATCAGCTTCA

ATGATTAAGCGCTACGATGAACATCATCAAGACTTGACTCTTTTAAAAGCTTTAGTTCGACAAC

AACTTCCAGAAAAGTATAAAGAAATCTTTTTTGATCAATCAAAAAACGGATATGCAGGTTATAT

TGATGGGGGAGCTAGCCAAGAAGAATTTTATAAATTTATCAAACCAATTTTAGAAAAAATGGAT

GGTACTGAGGAATTATTGGTGAAACTAAATCGTGAAGATTTGCTGCGCAAGCAACGGACCTTTG

ACAACGGCTCTATTCCCCATCAAATTCACTTGGGTGAGCTGCATGCTATTTTGAGAAGACAAGA

AGACTTTTATCCATTTTTAAAAGACAATCGTGAGAAGATTGAAAAAATCTTGACTTTTCGAATT

CCTTATTATGTTGGTCCATTGGCGCGTGGCAATAGTCGTTTTGCATGGATGACTCGGAAGTCTG

AAGAAACAATTACCCCATGGAATTTTGAAGAAGTTGTCGATAAAGGTGCTTCAGCTCAATCATT

TATTGAACGCATGACAAACTTTGATAAAAATCTTCCAAATGAAAAAGTACTACCAAAACATAGT

TTGCTTTATGAGTATTTTACGGTTTATAACGAATTGACAAAGGTCAAATATGTTACTGAGGGAA

TGCGAAAACCAGCATTTCTTTCAGGTGAACAGAAGAAAGCCATTGTTGATTTACTCTTCAAAAC

AAATCGAAAAGTAACCGTTAAGCAATTAAAAGAAGATTATTTCAAAAAAATAGAATGTTTTGAT

AGTGTTGAAATTTCAGGAGTTGAAGATAGATTTAATGCTTCATTAGGCGCCTACCATGATTTGC

TAAAAATTATTAAAGATAAAGATTTTTTGGATAATGAAGAAAATGAAGATATCTTAGAGGATAT

TGTTTTAACATTGACCTTATTTGAAGATAGGGGGATGATTGAGGAAAGACTTAAAACATATGCT

CACCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTTTT

GAAATCAGATGGTTTTGCCAATCGCAATTTTATGCAGCTGATCCATGATGATAGTTTGACATTT

AAAGAAGATATTCAAAAAGCACAGGTGTCTGGACAAGGCCATAGTTTACATGAACAGATTGCTA

ACTTAGCTGGCAGTCCTGCTATTAAAAAAGGTATTTTACAGACTGTAAAAATTGTTGATGAACT

GGTCAAAGTAATGGGGCATAAGCCAGAAAATATCGTTATTGAAATGGCACGTGAAAATCAGACA

ACTCAAAAGGGCCAGAAAAATTCGCGAGAGCGTATGAAACGAATCGAAGAAGGTATCAAAGAAT
```

-continued

TAGGAAGTCAGATTCTTAAAGAGCATCCTGTTGAAAATACTCAATTGCAAAATGAAAAGCTCTA

TCTCTATTATCTACAAAATGGAAGAGACATGTATGTGGACCAAGAATTAGATATTAATCGTTTA

AGTGATTATGATGTCGATCACATTGTTCCACAAAGTTTCATTAAAGACGATTCAATAGACAATA

AGGTACTAACGCGTTCTGATAAAAATCGTGGTAAATCGGATAACGTTCCAAGTGAAGAAGTAGT

CAAAAAGATGAAAAACTATTGGAGACAACTTCTAAACGCCAAGTTAATCACTCAACGTAAGTTT

GATAATTTAACGAAAGCTGAACGTGGAGGTTTGAGTGAACTTGATAAAGCTGGTTTTATCAAAC

GCCAATTGGTTGAAACTCGCCAAATCACTAAGCATGTGGCACAAATTTTGGATAGTCGCATGAA

TACTAAATACGATGAAAATGATAAACTTATTCGAGAGGTTAAAGTGATTACCTTAAAATCTAAA

TTAGTTTCTGACTTCCGAAAAGATTTCCAATTCTATAAAGTACGTGAGATTAACAATTACCATC

ATGCCCATGATGCGTATCTAAATGCCGTCGTTGGAACTGCTTTGATTAAGAAATATCCAAAACT

TGAATCGGAGTTTGTCTATGGTGATTATAAAGTTTATGATGTTCGTAAAATGATTGCTAAGTCT

GAGCAAGAAATAGGCAAAGCAACCGCAAAATATTTCTTTTACTCTAATATCATGAACTTCTTCA

AAACAGAAATTACACTTGCAAATGGAGAGATTCGCAAACGCCCTCTAATCGAAACTAATGGGGA

AACTGGAGAAATTGTCTGGGATAAAGGGCGAGATTTTGCCACAGTGCGCAAAGTATTGTCCATG

CCCCAAGTCAATATTGTCAAGAAAACAGAAGTACAGACAGGCGGATTCTCCAAGGAGTCAATTT

TACCAAAAGAAATTCGGACAAGCTTATTGCTCGTAAAAAAGACTGGGATCCAAAAAAATATGG

TGGTTTTGATAGTCCAACGGTAGCTTATTCAGTCCTAGTGGTTGCTAAGGTGGAAAAAGGGAAA

TCGAAGAAGTTAAAATCCGTTAAAGAGTTACTAGGGATCACAATTATGGAAAGAAGTTCCTTTG

AAAAAAATCCGATTGACTTTTTAGAAGCTAAAGGATATAAGGAAGTTAAAAAAGACTTAATCAT

TAAACTACCTAAATATAGTCTTTTTGAGTTAGAAAACGGTCGTAAACGGATGCTGGCTAGTGCC

GGAGAATTACAAAAAGGAAATGAGCTGGCTCTGCCAAGCAAATATGTGAATTTTTTATATTTAG

CTAGTCATTATGAAAAGTTGAAGGGTAGTCCAGAAGATAACGAACAAAAACAATTGTTTGTGGA

GCAGCATAAGCATTATTTAGATGAGATTATTGAGCAAATCAGTGAATTTTCTAAGCGTGTTATT

TTAGCAGATGCCAATTTAGATAAAGTTCTTAGTGCATATAACAAACATAGAGACAAACCAATAC

GTGAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATGCC

ACTCTTATCCATCAATCCATCACTGGTCTTTATGAAACACGCATTGATTTGAGTCAGCTAGGAG

GTGACTGA

An exemplary *Streptococcus pyogenes* Cas9 (spCas9) amino acid sequence is provided below:

MDKKYSIGLDIGTNSVGWAVITDDYKVPSKKFKVLGNTDRHSIKKNLIGALLFGSGETAEATRL

KRTARRRYTRRKNRICYLQEIFSNEMAKVDDSFFHRLEESFLVEEDKKHERHPIFGNIVDEVAY

HEKYPTIYHLRKKLADSTDKADLRLIYLALAHMIKFRGHFLIEGDLNPDNSDVDKLFIQLVQIY

NQLFEENPINASRVDAKAILSARLSKSRRLENLIAQLPGEKRNGLFGNLIALSLGLTPNFKSNE

DLAEDAKLQLSKDTYDDDLDNLLAQIGDQYADLFLAAKNLSDAILLSDILRVNSEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGAYHDLLKIIKDKDFLDNEENEDILEDIVLTLTLFEDRGMIEERLKTYA

US 12,594,301 B2

203                    204

-continued

```
HLFDDKVMKQLKRRRYTGWGRLSRKLINGIRDKQSGKTILDFLKSDGFANRNFMQLIHDDSLTF

KEDIQKAQVSGQGHSLHEQIANLAGSPAIKKGILQTVKIVDELVKVMGHKPENIVIEMARENQT

TQKGQKNSRERMKRIEEGIKELGSQILKEHPVENTQLQNEKLYLYYLQNGRDMYVDQELDINRL

SDYDVDHIVPQSFIKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSK

LVSDFRKDFQFYKVREINNYHHAHDAYLNAVVGTALIKKYPKLESEFVYGDYKVYDVRKMIAKS

EQEIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASA

GELQKGNELALPSKYVNFLYLASHYEKLKGSPEDNEQKQLFVEQHKHYLDEIIEQISEFSKRVI

LADANLDKVLSAYNKHRDKPIREQAENIIHLETLTNLGAPAAFKYFDTTIDRKRYTSTKEVLDA

TLIHQSITGLYETRIDLSQLGGD
```

(single underline: HNH domain; double underline: RuvC domain)

In some embodiments, wild-type Cas9 corresponds to, or comprises the following nucleotide sequences:

```
ATGGATAAAAAGTATTCTATTGGTTTAGACATCGGCACTAATTCCGTTGGATGGGCTGTCATAA

CCGATGAATACAAAGTACCTTCAAAGAAATTTAAGGTGTTGGGGAACACAGACCGTCATTCGAT

TAAAAAGAATCTTATCGGTGCCCTCCTATTCGATAGTGGCGAAACGGCAGAGGCGACTCGCCTG

AAACGAACCGCTCGGAGAAGGTATACACGTCGCAAGAACCGAATATGTTACTTACAAGAAATTT

TTAGCAATGAGATGGCCAAAGTTGACGATTCTTTCTTTCACCGTTTGGAAGAGTCCTTCCTTGT

CGAAGAGGACAAGAAACATGAACGGCACCCCATCTTTGGAAACATAGTAGATGAGGTGGCATAT

CATGAAAAGTACCCAACGATTTATCACCTCAGAAAAAAGCTAGTTGACTCAACTGATAAAGCGG

ACCTGAGGTTAATCTACTTGGCTCTTGCCCATATGATAAAGTTCCGTGGGCACTTTCTCATTGA

GGGTGATCTAAATCCGGACAACTCGGATGTCGACAAACTGTTCATCCAGTTAGTACAAACCTAT

AATCAGTTGTTTGAAGAGAACCCTATAAATGCAAGTGGCGTGGATGCGAAGGCTATTCTTAGCG

CCCGCCTCTCTAAATCCCGACGGCTAGAAAACCTGATCGCACAATTACCCGGAGAGAAGAAAAA

TGGGTTGTTCGGTAACCTTATAGCGCTCTCACTAGGCCTGACACCAAATTTTAAGTCGAACTTC

GACTTAGCTGAAGATGCCAAATTGCAGCTTAGTAAGGACACGTACGATGACGATCTCGACAATC

TACTGGCACAAATTGGAGATCAGTATGCGGACTTATTTTTGGCTGCCAAAAACCTTAGCGATGC

AATCCTCCTATCTGACATACTGAGAGTTAATACTGAGATTACCAAGGCGCCGTTATCCGCTTCA

ATGATCAAAAGGTACGATGAACATCACCAAGACTTGACACTTCTCAAGGCCCTAGTCCGTCAGC

AACTGCCTGAGAAATATAAGGAAATATTCTTTGATCAGTCGAAAAACGGGTACGCAGGTTATAT

TGACGGCGGAGCGAGTCAAGAGGAATTCTACAAGTTTATCAAACCCATATTAGAGAAGATGGAT

GGGACGGAAGAGTTGCTTGTAAAACTCAATCGCGAAGATCTACTGCGAAAGCAGCGGACTTTCG

ACAACGGTAGCATTCCACATCAAATCCACTTAGGCGAATTGCATGCTATACTTAGAAGGCAGGA

GGATTTTTATCCGTTCCTCAAAGACAATCGTGAAAAGATTGAGAAAATCCTAACCTTTCGCATA

CCTTACTATGTGGGACCCCTGGCCCGAGGGAACTCTCGGTTCGCATGGATGACAAGAAAGTCCG

AAGAAACGATTACTCCATGGAATTTTGAGGAAGTTGTCGATAAAGGTGCGTCAGCTCAATCGTT

CATCGAGAGGATGACCAACTTTGACAAGAATTTACCGAACGAAAAAGTATTGCCTAAGCACAGT

TTACTTTACGAGTATTTCACAGTGTACAATGAACTCACGAAAGTTAAGTATGTCACTGAGGGCA
```

-continued

```
TGCGTAAACCCGCCTTTCTAAGCGGAGAACAGAAGAAAGCAATAGTAGATCTGTTATTCAAGAC

CAACCGCAAAGTGACAGTTAAGCAATTGAAAGAGGACTACTTTAAGAAAATTGAATGCTTCGAT

TCTGTCGAGATCTCCGGGGTAGAAGATCGATTTAATGCGTCACTTGGTACGTATCATGACCTCC

TAAAGATAATTAAAGATAAGGACTTCCTGGATAACGAAGAGAATGAAGATATCTTAGAAGATAT

AGTGTTGACTCTTACCCTCTTTGAAGATCGGGAAATGATTGAGGAAAGACTAAAAACATACGCT

CACCTGTTCGACGATAAGGTTATGAAACAGTTAAAGAGGCGTCGCTATACGGGCTGGGGACGAT

TGTCGCGGAAACTTATCAACGGGATAAGAGACAAGCAAAGTGGTAAAACTATTCTCGATTTTCT

AAAGAGCGACGGCTTCGCCAATAGGAACTTTATGCAGCTGATCCATGATGACTCTTTAACCTTC

AAAGAGGATATACAAAAGGCACAGGTTTCCGGACAAGGGGACTCATTGCACGAACATATTGCGA

ATCTTGCTGGTTCGCCAGCCATCAAAAAGGGCATACTCCAGACAGTCAAAGTAGTGGATGAGCT

AGTTAAGGTCATGGGACGTCACAAACCGGAAAACATTGTAATCGAGATGGCACGCGAAAATCAA

ACGACTCAGAAGGGGCAAAAAAACAGTCGAGAGCGGATGAAGAGAATAGAAGAGGGTATTAAAG

AACTGGGCAGCCAGATCTTAAAGGAGCATCCTGTGGAAAATACCCAATTGCAGAACGAGAAACT

TTACCTCTATTACCTACAAAATGGAAGGGACATGTATGTTGATCAGGAACTGGACATAAACCGT

TTATCTGATTACGACGTCGATCACATTGTACCCCAATCCTTTTTGAAGGACGATTCAATCGACA

ATAAAGTGCTTACACGCTCGGATAAGAACCGAGGGAAAAGTGACAATGTTCCAAGCGAGGAAGT

CGTAAAGAAAATGAAGAACTATTGGCGGCAGCTCCTAAATGCGAAACTGATAACGCAAAGAAAG

TTCGATAACTTAACTAAAGCTGAGAGGGGTGGCTTGTCTGAACTTGACAAGGCCGGATTTATTA

AACGTCAGCTCGTGGAAACCCGCCAAATCACAAAGCATGTTGCACAGATACTAGATTCCCGAAT

GAATACGAAATACGACGAGAACGATAAGCTGATTCGGGAAGTCAAAGTAATCACTTTAAAGTCA

AAATTGGTGTCGGACTTCAGAAAGGATTTTCAATTCTATAAAGTTAGGGAGATAAATAACTACC

ACCATGCGCACGACGCTTATCTTAATGCCGTCGTAGGGACCGCACTCATTAAGAAATACCCGAA

GCTAGAAAGTGAGTTTGTGTATGGTGATTACAAAGTTTATGACGTCCGTAAGATGATCGCGAAA

AGCGAACAGGAGATAGGCAAGGCTACAGCCAAATACTTCTTTTATTCTAACATTATGAATTTCT

TTAAGACGGAAATCACTCTGGCAAACGGAGAGATACGCAAACGACCTTTAATTGAAACCAATGG

GGAGACAGGTGAAATCGTATGGGATAAGGGCCGGGACTTCGCGACGGTGAGAAAAGTTTTGTCC

ATGCCCCAAGTCAACATAGTAAAGAAAACTGAGGTGCAGACCGGAGGGTTTTCAAAGGAATCGA

TTCTTCCAAAAAGGAATAGTGATAAGCTCATCGCTCGTAAAAAGGACTGGGACCCGAAAAAGTA

CGGTGGCTTCGATAGCCCTACAGTTGCCTATTCTGTCCTAGTAGTGGCAAAAGTTGAGAAGGGA

AAATCCAAGAAACTGAAGTCAGTCAAAGAATTATTGGGGATAACGATTATGGAGCGCTCGTCTT

TTGAAAAGAACCCCATCGACTTCCTTGAGGCGAAAGGTTACAAGGAAGTAAAAAAGGATCTCAT

AATTAAACTACCAAAGTATAGTCTGTTTGAGTTAGAAAATGGCCGAAAACGGATGTTGGCTAGC

GCCGGAGAGCTTCAAAAGGGGAACGAACTCGCACTACCGTCTAAATACGTGAATTTCCTGTATT

TAGCGTCCCATTACGAGAAGTTGAAAGGTTCACCTGAAGATAACGAACAGAAGCAACTTTTTGT

TGAGCAGCACAAACATTATCTCGACGAAATCATAGAGCAAATTTCGGAATTCAGTAAGAGAGTC

ATCCTAGCTGATGCCAATCTGGACAAAGTATTAAGCGCATACAACAAGCACAGGGATAAACCCA

TACGTGAGCAGGCGGAAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAGAC

GCGACACTGATTCACCAATCCATCACGGGATTATATGAAACTCGGATAGATTTGTCACAGCTTG

GGGGTGACGGATCCCCCAAGAAGAAGAGGAAAGTCTCGAGCGACTACAAAGACCATGACGGTGA

TTATAAAGATCATGACATCGATTACAAGGATGACGATGACAAGGCTGCAGGA
```

In some embodiments, wild-type Cas9 corresponds to, or comprises the following amino acid sequence:

MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTE

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC [40] domain).

In some embodiments, wild-type Cas9 corresponds to Cas9 from *Streptococcus pyogenes* (NCBI Reference Sequence: NC_002737.2 (nucleotide sequence as follows)):

ATGGATAAGAAATACTCAATAGGCTTAGATATCGGCACAAATAGCGTCGGATGGGCGGTGATCA

CTGATGAATATAAGGTTCCGTCTAAAAAGTTCAAGGTTCTGGGAAATACAGACCGCCACAGTAT

CAAAAAAAATCTTATAGGGGCTCTTTTATTTGACAGTGGAGAGACAGCGGAAGCGACTCGTCTC

AAACGGACAGCTCGTAGAAGGTATACACGTCGGAAGAATCGTATTTGTTATCTACAGGAGATTT

TTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTAT

CATGAGAAATATCCAACTATCTATCATCTGCGAAAAAAATTGGTAGATTCTACTGATAAAGCGG

ATTTGCGCTTAATCTATTTGGCCTTAGCGCATATGATTAAGTTTCGTGGTCATTTTTTGATTGA

GGGAGATTTAAATCCTGATAATAGTGATGTGGACAAACTATTTATCCAGTTGGTACAAACCTAC

AATCAATTATTTGAAGAAAACCCTATTAACGCAAGTGGAGTAGATGCTAAAGCGATTCTTTCTG

CACGATTGAGTAAATCAAGACGATTAGAAAATCTCATTGCTCAGCTCCCCGGTGAGAAGAAAAA

TGGCTTATTTGGGAATCTCATTGCTTTGTCATTGGGTTTGACCCCTAATTTTAAATCAAATTTT

GATTTGGCAGAAGATGCTAAATTACAGCTTTCAAAAGATACTTACGATGATGATTTAGATAATT

-continued

```
TATTGGCGCAAATTGGAGATCAATATGCTGATTTGTTTTTGGCAGCTAAGAATTTATCAGATGC

TATTTTACTTTCAGATATCCTAAGAGTAAATACTGAAATAACTAAGGCTCCCCTATCAGCTTCA

ATGATTAAACGCTACGATGAACATCATCAAGACTTGACTCTTTTAAAAGCTTTAGTTCGACAAC

AACTTCCAGAAAAGTATAAAGAAATCTTTTTTGATCAATCAAAAAACGGATATGCAGGTTATAT

TGATGGGGGAGCTAGCCAAGAAGAATTTTATAAATTTATCAAACCAATTTTAGAAAAAATGGAT

GGTACTGAGGAATTATTGGTGAAACTAAATCGTGAAGATTTGCTGCGCAAGCAACGGACCTTTG

ACAACGGCTCTATTCCCCATCAAATTCACTTGGGTGAGCTGCATGCTATTTTGAGAAGACAAGA

AGACTTTTATCCATTTTTAAAAGACAATCGTGAGAAGATTGAAAAAATCTTGACTTTTCGAATT

CCTTATTATGTTGGTCCATTGGCGCGTGGCAATAGTCGTTTTGCATGGATGACTCGGAAGTCTG

AAGAAACAATTACCCCATGGAATTTTGAAGAAGTTGTCGATAAAGGTGCTTCAGCTCAATCATT

TATTGAACGCATGACAAACTTTGATAAAAATCTTCCAAATGAAAAGTACTACCAAAACATAGT

TTGCTTTATGAGTATTTTACGGTTTATAACGAATTGACAAAGGTCAAATATGTTACTGAAGGAA

TGCGAAAACCAGCATTTCTTTCAGGTGAACAGAAGAAAGCCATTGTTGATTTACTCTTCAAAAC

AAATCGAAAAGTAACCGTTAAGCAATTAAAAGAAGATTATTTCAAAAAAATAGAATGTTTTGAT

AGTGTTGAAATTTCAGGAGTTGAAGATAGATTTAATGCTTCATTAGGTACCTACCATGATTTGC

TAAAAATTATTAAAGATAAAGATTTTTTGGATAATGAAGAAAATGAAGATATCTTAGAGGATAT

TGTTTTAACATTGACCTTATTTGAAGATAGGGAGATGATTGAGGAAAGACTTAAAACATATGCT

CACCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTTTT

GAAATCAGATGGTTTTGCCAATCGCAATTTTATGCAGCTGATCCATGATGATAGTTTGACATTT

AAAGAAGACATTCAAAAAGCACAAGTGTCTGGACAAGGCGATAGTTTACATGAACATATTGCAA

ATTTAGCTGGTAGCCCTGCTATTAAAAAAAGGTATTTTACAGACTGTAAAAGTTGTTGATGAATT

GGTCAAAGTAATGGGGCGGCATAAGCCAGAAAATATCGTTATTGAAATGGCACGTGAAAATCAG

ACAACTCAAAAGGGCCAGAAAAATTCGCGAGAGCGTATGAAACGAATCGAAGAAGGTATCAAAG

AATTAGGAAGTCAGATTCTTAAAGAGCATCCTGTTGAAAATACTCAATTGCAAAATGAAAAGCT

CTATCTCTATTATCTCCAAAATGGAAGAGACAAGTATGTGGACCAAGAAATAGATATTAATCGT

TTAAGTGATTATGATGTCGATCACATTGTTCCACAAAGTTTCCTTAAAGACGATTCAATAGACA

ATAAGGTCTTAACGCGTTCTGATAAAAATCGTGGTAAATCGGATAACGTTCCAAGTGAAGAAGT

AGTCAAAAAGATGAAAAACTATTGGAGACAACTTCTAAACGCCAAGTTAATCACTCAACGTAAG

TTTGATAATTTAACGAAAGCTGAACGTGGAGGTTTGAGTGAACTTGATAAAGCTGGTTTTATCA

AACGCCAATTGGTTGAAACTCGCCAAATCACTAAGCATGTGGCACAAATTTTGGATAGTCGCAT

GAATACTAAATACGATGAAAATGATAAACTTATTCGAGAGGTTAAAGTGATTACCTTAAAATCT

AAATTAGTTTCTGACTTCCGAAAAGATTTCCAATTCTATAAAGTACGTGAGATTAACAATTACC

ATCATGCCCATGATGCGTATCTAAATGCCGTCGTTGGAACTGCTTTGATTAAGAAATATCCAAA

ACTTGAATCGGAGTTTGTCTATGGTGATTATAAAGTTTATGATGTTCGTAAAATGATTGCTAAG

TCTGAGCAAGAAATAGGCAAAGCAACCGCAAAATATTTCTTTTACTCTAATATCATGAACTTCT

TCAAAACAGAAATTACACTTGCAAATGGAGAGATTCGCAAACGCCCTCTAATCGAAACTAATGG

GGAAACTGGAGAAATTGTCTGGGATAAAGGGCGAGATTTTGCCACAGTGCGCAAAGTATTGTCC

ATGCCCCAAGTCAATATTGTCAAGAAAACAGAAGTACAGACAGGCGGATTCTCCAAGGAGTCAA

TTTTTACCAAAAAGAAATTCGGACAAGCTTATTGCTCGTAAAAAAGACTGGGATCCAAAAAAATA
```

-continued

```
TGGTGGTTTTGATAGTCCAACGGTAGCTTATTCAGTCCTAGTGGTTGCTAAGGTGGAAAAAGGG

AAATCGAAGAAGTTAAAATCCGTTAAAGAGTTACTAGGGATCACAATTATGGAAAGAAGTTCCT

TTGAAAAAAATCCGATTGACTTTTTAGAAGCTAAAGGATATAAGGAAGTTAAAAAAGACTTAAT

CATTAAACTACCTAAATATAGTCTTTTTGAGTTAGAAAACGGTCGTAAACGGATGCTGGCTAGT

GCCGGAGAATTACAAAAAGGAAATGAGCTGGCTCTGCCAAGCAAATATGTGAATTTTTTATATT

TAGCTAGTCATTATGAAAAGTTGAAGGGTAGTCCAGAAGATAACGAACAAAAACAATTGTTTGT

GGAGCAGCATAAGCATTATTTAGATGAGATTATTGAGCAAATCAGTGAATTTTCTAAGCGTGTT

ATTTTAGCAGATGCCAATTTAGATAAAGTTCTTAGTGCATATAACAAACATAGAGACAAACCAA

TACGTGAACAAGCAGAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAGAT

GCCACTCTTATCCATCAATCCATCACTGGTCTTTATGAAACACGCATTGATTTGAGTCAGCTAG

GAGGTGACTGA
```

In some embodiments, wild-type Cas9 corresponds to Cas9 from *Streptococcus pyogenes* (Uniprot Reference Sequence: Q99ZW2 (amino acid sequence as follows)):

MDKK<u>YSIGLDIGTNSVGWAVI TEDYKVPSKKFKVLGNTDRHSIKKNLIGALLFDSGET</u>AEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQG<u>DSLHEHIANLAGSPAIKKGILQTVKVVDELVKVMGRHKPENIVIEM</u>ARENQ

TTQKGQKNSRERMKRIEEGIKELGSQILKEHPVENTQLQNEKLYLYYLQNGRDMYVDQELDINR

<u>LSDYDVDHIVPQSFLKDDSIDNKVLTRSDKNRGKSDNVPSEEVVKKMKNYWRQLLNAKLITQRK</u>

<u>FDNLTKAERGG</u>LSELDKAGFI<u>KRQLVETRQITKHVAQILDSRMNTKYDENDKLIREVKVITLKS</u>

<u>KLVSDFRKDFQFYKVREINNYHHAHDAYLNAVVGTALIKKYPKLESEFVYGDYKVYDVRKMIAK</u>

<u>SEQEIGKATAKYFFYSNIMNFFKTEITLANGEIRKRPLIETNGETGEIVWDKGRDFATVRKVLS</u>

<u>MPQVNIVKKTEVQT</u>GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1),

*Campylobacter jejuni* (NCBI Ref: YP_002344900.1) or *Neisseria meningitidis* (NCBI Ref: YP_002342100.1) or to a Cas9 from any other organism.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124).

The amino acid sequence of an exemplary catalytically inactive Cas9 (dCas9) is as follows: MDKKYSIGLAIGTNSVGWAVITDEYKVPSKKFKVLG-NTDRHSIKKNLIGALLFDSGETAEATRL KRTARR-RYTRRKNRICYLQEIFSNEMAKVDDSFFHRLEESFLV-EEDKKHERHPIFGNIVDEVAY HEKYPTIYHLRK-KLVDSTDKADLRLIYLALAHMIKFRGHFLIEGD-LNPDNSDVDKLFIQLVQTY NQLFEENPINASGVD-AKAILSARLSKSRRLENLIAQLPGEKKNGLFGNLIA-LSLGLTPNFKSNF DLAEDAKLQLSKDTYDDDLDNL-LAQIGDQYADLFLAAKNLSDAILLSDILRVNT-EITKAPLSAS MIKRYDEHHQDLTLLKALVRQQL-PEKYKEIFFDQSKNGYAGYIDGGASQEEFYKFIK-PILEKMD GTEELLVKLNREDLLRKQRTFDNG-SIPHQIHLGELHAILRRQEDFYPFLKDNREKIEKILTFRI PYYVGPLARGNSRFAWMTRKSEETITPWNFEEVVD-KGASAQSFIERMTNFDKNLPNEKVLPKHS LLY-EYFTVYNELTKVKYVTEGMRKPAFLSGEQKKAIV-DLLFKTNRKVTVKQLKEDYFKKIECFD SVEISGVE-DRFNASLGTYHDLLKIIKDKDFLDNEENEDILEDI-VLTLTLFEDREMIEERLKTYA HLFDDKVMKQLKRR-RYTGWGRLSRKLINGIRDKQSGKTILDFLKSDGFAN-RNFMQLIHDDSLTF KEDIQKAQVSGQGDSLHEHIAN-LAGSPAIKKGILQTVKVVDELVKVMGRHKPENIVI-EMARENQ TTQKGQKNSRERMKRIEEGIKELGSQI-LKEHPVENTQLQNEKLYLYYLQNGRDMYVDQELD-INR LSDYDVDAIVPQSFLKDDSIDNKVLTRSDKN-RGKSDNVPSEEVVKKMKNYWRQLLNAKLITQRK FDNLTKAERGGLSELDKAGFIKRQLVETRQITKH-VAQILDSRMNTKYDENDKLIREVKVITLKS KLVSD-FRKDFQFYKVREINNYHHAHDAYLNAVVGTALIK-KYPKLESEFVYGDYKVYDVRKMIAK SEQEIGKAT-AKYFFYSNIMNFFKTEITLANGEIRKRPLIETNGETG-EIVWDKGRDFATVRKVLS MPQVNIVKKTEVQT-GGFSKESILPKRNSDKLIARKKDWDPKKYGGFD-SPTVAYSVLVVAKVEKG KSKKLKSVKELLGITIM-ERSSFEKNPIDFLEAKGYKEVKKDLIIKLPKYSLFE-LENGRKRMLAS AGELQKGNELALPSKYVNF- LYLASHYEKLKGSPEDNEQKQLFVEQHKHYL-DEIIEQISEFSKRV ILADANLDKVLSAYNKHRDK-PIREQAENIIHLFTLTNLGAPAAFKYFDTTIDRKRYT-STKEVLD ATLIHQSITGLYETRIDLSQLGGD (SEQ ID NO: 236) (see, e.g., Qi et al., "Repurposing CRISPR as an RNA-guided platform for sequence-specific control of gene expression." *Cell*. 2013; 152(5):1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology*. 2013; 31(9): 833-838, the entire contents of which are incorporated herein by reference).

In some embodiments, a Cas9 nuclease has an inactive (e.g., an inactivated) DNA cleavage domain, that is, the Cas9 is a nickase, referred to as an "nCas9" protein (for "nickase" Cas9). A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science*. 337:816-821(2012); Qi et al., "Repurposing CRISPR as an RNA-Guided Platform for Sequence-Specific Control of Gene Expression" (2013) *Cell*. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., *Cell*. 28; 152(5):1173-83 (2013)).

In some embodiments, the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, dCas9 corresponds to, or comprises in part or in whole, a Cas9 amino acid sequence having one or more mutations that inactivate the Cas9 nuclease activity. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. In some embodiments, a nuclease-inactive Cas9 domain comprises the amino acid sequence set forth in Cloning vector pPlatTET-gRNA2 (Accession No. BAV54124).

In some embodiments, the dCas9 comprises the amino acid sequence of dCas9 (D10A and H840A):

MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNE

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQG̲D̲S̲L̲H̲E̲H̲I̲A̲N̲L̲A̲G̲S̲P̲A̲I̲K̲K̲G̲I̲L̲Q̲T̲V̲K̲V̲V̲D̲E̲L̲V̲K̲V̲M̲G̲R̲H̲K̲P̲E̲N̲I̲V̲I̲E̲M̲A̲R̲E̲N̲Q̲

T̲T̲Q̲K̲G̲Q̲K̲N̲S̲R̲E̲R̲M̲K̲R̲I̲E̲E̲G̲I̲K̲E̲L̲G̲S̲Q̲I̲L̲K̲E̲H̲P̲V̲E̲N̲T̲Q̲L̲Q̲N̲E̲K̲L̲Y̲L̲Y̲Y̲L̲Q̲N̲G̲R̲D̲M̲Y̲V̲D̲Q̲E̲L̲D̲I̲N̲R̲

L̲S̲D̲Y̲D̲V̲D̲A̲I̲V̲P̲Q̲S̲F̲L̲K̲D̲D̲S̲I̲D̲N̲K̲V̲L̲T̲R̲S̲D̲K̲N̲R̲G̲K̲S̲D̲N̲V̲P̲S̲E̲E̲V̲V̲K̲K̲M̲K̲N̲Y̲W̲R̲Q̲L̲L̲N̲A̲K̲L̲I̲T̲Q̲R̲K̲

F̲D̲N̲L̲T̲K̲A̲E̲R̲G̲G̲L̲S̲E̲L̲D̲K̲A̲G̲F̲I̲K̲R̲Q̲L̲V̲E̲T̲R̲Q̲I̲T̲K̲H̲V̲A̲Q̲I̲L̲D̲S̲R̲M̲N̲T̲K̲Y̲D̲E̲N̲D̲K̲L̲I̲R̲E̲V̲K̲V̲I̲T̲L̲K̲S̲

K̲L̲V̲S̲D̲F̲R̲K̲D̲F̲Q̲F̲Y̲K̲V̲R̲E̲I̲N̲N̲Y̲H̲H̲A̲H̲D̲A̲Y̲L̲N̲A̲V̲V̲G̲T̲A̲L̲I̲K̲K̲Y̲P̲K̲L̲E̲S̲E̲F̲V̲Y̲G̲D̲Y̲K̲V̲Y̲D̲V̲R̲K̲M̲I̲A̲K̲

S̲E̲Q̲E̲I̲G̲K̲A̲T̲A̲K̲Y̲F̲F̲Y̲S̲N̲I̲M̲N̲F̲F̲K̲T̲E̲I̲T̲L̲A̲N̲G̲E̲I̲R̲K̲R̲P̲L̲I̲E̲T̲N̲G̲E̲T̲G̲E̲I̲V̲W̲D̲K̲G̲R̲D̲F̲A̲T̲V̲R̲K̲V̲L̲S̲

M̲P̲Q̲V̲N̲I̲V̲K̲K̲T̲E̲V̲Q̲T̲GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC domain).

In some embodiments, the amino acid sequence of an exemplary catalytically inactive Cas9 (dCas9) is as follows:

MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNE

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

```
-continued
HLFDDKVMKQLKRRRYTGWGRLSRKLINGIRDKQSGKTILDFLKSDGFANRNFMQLIHDDSLTE

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDAIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKIVNFLYLASHIEKLKGSPEDNEQKQLHVEQHKHYDDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
```

(see, e.g., Qi et al., "Repurposing CRISPR as an RNA-guided platform for sequence-specific control of gene expression." *Cell*. 2013; 152(5):1173-83, the entire contents of which are incorporated herein by reference).

In some embodiments, the amino acid sequence of an exemplary catalytically inactive Cas9 (dCas9) is as follows:

```
MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDAIVPQSFLKDDS1DNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLHVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
```

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology*. 2013; 31(9): 833-838, the entire contents of which are incorporated herein by reference).

is a nickase, referred to as an "nCas9" protein (for "nickase" Cas9). The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

The amino acid sequence of an exemplary catalytically Cas9 nickase (nCas9) is as follows:

```
MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNE

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKYLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
```

In some embodiments, a Cas9 nuclease has an inactive (e.g., an inactivated) DNA cleavage domain, that is, the Cas9

In some embodiments, Cas9 refers to a Cas9 from archaea (e.g., nanoarchaea), which constitute a domain and kingdom of single-celled prokaryotic microbes. In some embodiments, the nucleic acid programmable DNA binding protein may be a CasX or CasY protein, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, in a base editor system described herein Cas9 is replaced by CasX, or a variant of CasX. In some embodiments, in a base editor system described herein Cas9 is replaced by CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the programmable nucleotide binding protein comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. In some embodiments, the programmable nucleotide binding protein is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. It should be appreciated that CasX and CasY from other bacterial species may also be used in accordance with the present disclosure.

An exemplary CasX ((uniprot.org/uniprot/F0NN87; uniprot.org/uniprot/F0NH53) tr|F0NN87|F0NN87_SULIHCRISPR-associatedCasx protein OS=*Sulfolobus islandicus* (strain HVE10/4) GN=SiH_0402 PE=4 SV=1) amino acid sequence is as follows:

```
MEVPLYNIFGDNYIIQVATEAENSTIYNNKVEIDDEELRNVLNLAYKIAKNNEDAAAERRGKAK

KKKGEEGETTTSNIILPLSGNDKNPWTETLKCYNFPTTVALSEVFKNFSQVKECEEVSAPSFVK

PEFYEFGRSPGMVERTRRVKLEVEPHYLIIAAAGWVLTRLGKAKVSEGDYVGVNVFTPTRGILY

SLIQNVNGIVPGIKPETAFGLWIARKVVSSVTNPNVSVVRIYTISDAVGQNPTTINGGFSIDLT

KLLEKRYLLSERLEAIARNALSISSNMRERYIVLANYIYEYLTG SKRLEDLLYFANRDLIMNI

NSDDGKVRDLKLISAYVNGELIRGEG.
```

An exemplary CasX (>tr|F0NH53|F0NH53_SULIR CRISPR associated protein, Casx OS=*Sulfolobus islandicus* (strain REY15A) GN=SiRe_0771 PE=4 SV=1) amino acid sequence is as follows:

```
MEVPLYNIFGDNYIIQVATEAENSTIYNNKVEIDDEELRNVLNLAYKIAKNNEDAAAERRGKAK

KKKGEEGETTTSNIILPLSGNDKNPWTETLKCYNFPTTVALSEVFKNFSQVKECEEVSAPSFVK

PEFYKFGRSPGMVERTRRVKLEVEPHYLIMAAAGWVLTRLGKAKVSEGDYVGVNVFTPTRGILY

SLIQNVNGIVPGIKPETAFGLWIARKVVSSVTNPNVSVVSIYTISDAVGQNPTTINGGFSIDLT

KLLEKRDLLSERLEAIARNALSISSNMRERYTVLANYIYEYLTGSKRLEDLLYFANRDLIMNLN

SDDGKVRDLKLISAYVNGELIRGEG.
```

Deltaproteobacteria CasX
```
MEKRINKIRKKLSADNATKPVSRSGPMKTLLVRVMTDDLKKRLEKRRKKPEVMPQVISNNAANN

LRMLLDDYTKMKEAILQVYWQEFKDDHVGLMCKFAQPASKKIDQNKLKPEMDEKGNLTTAGFAC

SQCGQPLFVYKLEQVSEKGKAYTNYFGRCNVAEHEKLILLAQLKPVKDSDEAVTYSLGKFGQRA

LDFYSIHVTKESTHPVKPLAQIAGNRYASGPVGKALSDACMGTIASFLSKYQDIIIEHQKVVKG

NQKRLESLRELAGKENLEYPSVTLPPQPHTKEGVDfAYNEVIARVRMWVNLNLWQKLKLSRDDA

KPLLRLKGFPSFPVVERRENEVDWWNTINEVKKLIDAKRDMGRVFWSGVTAEKRNTILEGYNYL

PNENDHKKREGSLENPKKPAKRQFGDLLLYLEKKYAGDWGKVFDEAWERIDKKIAGLTSHIERE

EARNAEDAQSKAVLTDWLRAKASFVLERLKEMDEKEFYACEIQLQKWYGDLRGNPFAVEAENRV

VDISGFSIGSDGHSIQYRNLLAWKYLENGKREFYLLMNYGKKGRIRFTDGTDIKKSGKWQGLLY
```

-continued

GGGKAKVIDLTFDPDDEQLIILPLAFGTRQGREFIWNDLLSLETGLIKLANGRVIEKTIYNKKI

GRDEPALFVALTFERREVVDPSNIKPVNLIGVARGENIPAVIALTDPEGCPLPEFKDSSGGPTD

ILRIGEGYKEKQRAIQAAKEVEQRRAGGYSRKFASKSRNLADDMVRNSARDLFYHAVTHDAVLV

FANLSRGFGRQGKRTFMTERQYTKMEDWLTAKLAYEGLTSKTYLSKTLAQYTSKTCSNCGFTIT

YADMDVMLVRLKKTSDGWATTLNNKELKAEYQITYYNRYKRQTVEKELSAELDRLSEESGNNDI

SKWTKGRRDEALFLLKKRFSHRPVQEQFVCLDCGHEVHAAEQAALNIARSWLFLNSNSTEFKSY

KSGKQPFVGAWQAFYKRRLKEVWKPNA

An exemplary CasY ((ncbi.nlm.nih.gov/protein/ APG80656.1)>APG80656.1 CRISPR-associated protein CasY [uncultured Parcubacteria group bacterium]) amino acid sequence is as follows:

MSKRHPRISGVKGYRLHAQRLEYTGKSGAMRTIKYPLYSSPSGGRTVPREIVSAINDDYVGLYG

LSNFDDLYNAEKRNEEKVYSVLDFWYDCVQYGAVFSYTAPGLLKNVAEVRGGSYELTKTLKGSH

LYDELQIDKVIKFLNKKEISRANGSLDKLKKDIIDCFKAEYRERHKDQCNKLADDIKNAKKDAG

ASLGERQKKLFRDFFGISEQSENDKPSFTNPLNLTCCLLPFDTVNNNRNRGEVLFNKLKEYAQK

LDKNEGSLEMWEYIGIGNSGTAFSNFLGEGFLGRLRENKITELKKAMMDITDAWRGQEQEEELE

KRLRILAALTIKLREPKFDNHWGGYRSDINGKLSSWLQNYINQTVKIKEDLKGHKKDLKKAKEM

INRFGESDTKEEAVVSSLLESIEKIVPDDSADDEKPDIPAIAIYRRFLSDGRLTLNRFVQREDV

QEALLKERLEAEKKKKPKKRKKKSDAEDEKETIDEKELFPHLAKPLKLVPNEYGDSKRELYKKY

KNAAIYTDALWKAVEKIYKSAFSSSLKNSFFDTDFDKDFFIKRLQKIFSVYRRFNTDKWKPIVK

NSFAPYCDIVSLAENEVLYKPKQSRSRKSAAIDKNRVRLPSTENIAKAGIALARELSVAGFDWK

DLLKKEEHEEYIDLIELHKTALALLLAVTETQLDISALDFVENGTVKDFMKTRDGNLVLEGRFL

EMFSQSIVFSELRGLAGLMSRKEFITRSAIQTMNGKQAELLYIPHEFQSAKITTPKEMSRAFLD

LAPAEFATSLEPESLSEKSLLKLKQMRYYPHYFGYELTRTGQGIDGGVAENALRLEKSPVKKRE

IKCKQYKTLGRGQNKIVLYVRSSYYQTQFLEWFLHRPKNVQTDVAVSGSFLIDEKKVKTRWNYD

ALTVALEPVSGSERVFVSQPPFTIFPEKSAEEEGQRYLGIDIGEYGIAYTALEITGDSAKILDQN

FISDPQLKTLREEVKGLKLDQRRGTFAMPSTKIARIRESLVHSLRNRIHHLALKHKAKIVYELE

VSRFEEGKQKIKKVYATLKKADVYSEIDADKNLQTTVWGKLAVASEISASYTSQFCGACKKLWR

AEMQVDETITTQELTGTVRVIKGGTLIDAIKDFMRPPIFDENDTPFPKYRDFCDKHHISKKMRG

NSCLFICPFCRANADADIQASQTIALLRYVKEEKKVEDYFERFRKLKNIKVLGQMKKI.

The Cas9 nuclease has two functional endonuclease domains: RuvC and HNH. Cas9 undergoes a conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some embodiments, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)](e.g., $(b+c)/(a+b+c)$, where "a" is the band intensity of DNA substrate and "b" and "c" are the cleavage products).

In some embodiments, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2}) \times 100$, where "a" is the band intensity of DNA substrate and "b" and "c" are the cleavage products (Ran et. al., Cell. 2013 Sep. 12; 154(6):1380-9; and Ran et al., Nat Protoc. 2013 November; 8(11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most embodiments, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag.

In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some embodiments, Cas9 is a variant Cas9 protein. A variant Cas9 polypeptide has an amino acid sequence that is different by one amino acid (e.g., has a deletion, insertion, substitution, fusion) when compared to the amino acid sequence of a wild-type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some embodiments, the variant Cas9 protein has no substantial nuclease activity. When a subject Cas9 protein is a variant Cas9 protein that has no substantial nuclease activity, it can be referred to as "dCas9."

In some embodiments, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some embodiments, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337(6096):816-21).

In some embodiments, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some embodiments, a variant Cas9 protein has a reduced ability to cleave both the complementary and the non-complementary strands of a double stranded target DNA. As a non-limiting example, in some embodiments, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors W476A and WI 126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors P475A, W476A, N477A, D1125A, WI126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors H840A, W476A, and WI 126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors H840A, D10A, W476A, and WI 126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some embodiments, the variant Cas9 protein harbors, H840A, P475A, W476A, N477A, D1125A, WI 126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and WI126A mutations or when the variant Cas9 protein harbors P475A, W476A, N477A, D1125A, W1126A, and D1127A mutations, the variant Cas9 protein does not bind efficiently to a PAM sequence. Thus, in some such embodiments, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, a modified SpCas9 including amino acid substitutions D1135M, S1136Q, G1218K, E1219F, A1322R, D1332A, R1335E, and T1337R (SpCas9-MQKFRAER) and having specificity for the altered PAM 5'-NGC-3' was used.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9.

Furthermore, Cpf1, unlike Cas9, does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins that are more similar to types I and III than type II systems. Functional Cpf1 does not require the trans-activating CRISPR RNA (tracrRNA), therefore, only CRISPR (crRNA) is required. This benefits genome editing because Cpf1 is not only smaller than Cas9, but also it has a smaller sgRNA molecule (approximately half as many nucleotides as Cas9). The Cpf1-crRNA complex cleaves target DNA or RNA by identification of a protospacer adjacent motif 5'-YTN-3' or 5'-TTN-3' in contrast to the G-rich PAM targeted by Cas9. After identification of PAM, Cpf1 introduces a sticky-end-like DNA double-stranded break having an overhang of 4 or 5 nucleotides.

In some embodiments, the Cas9 is a Cas9 variant having specificity for an altered PAM sequence. In some embodiments, the Additional Cas9 variants and PAM sequences are described in Miller, S. M., et al. Continuous evolution of SpCas9 variants compatible with non-G PAMs, Nat. Biotechnol. (2020), the entirety of which is incorporated herein by reference. in some embodiments, a Cas9 variate have no specific PAM requirements. In some embodiments, a Cas9 variant, e.g. a SpCas9 variant has specificity for a NRNH PAM, wherein R is A or G and H is A, C, or T. In some embodiments, the SpCas9 variant has specificity for a PAM sequence AAA, TAA, CAA, GAA, TAT, GAT, or CAC. In some embodiments, the SpCas9 variant comprises an amino acid substitution at position 1114, 1134, 1135, 1137, 1139, 1151, 1180, 1188, 1211, 1218, 1219, 1221, 1249, 1256, 1264, 1290, 1318, 1317, 1320, 1321, 1323, 1332, 1333, 1335, 1337, or 1339 or a corresponding position thereof. In some embodiments, the SpCas9 variant comprises an amino acid substitution at position 1114, 1135, 1218, 1219, 1221, 1249, 1320, 1321, 1323, 1332, 1333, 1335, or 1337 or a corresponding position thereof. In some embodiments, the SpCas9 variant comprises an amino acid substitution at position 1114, 1134, 1135, 1137, 1139, 1151, 1180, 1188, 1211, 1219, 1221, 1256, 1264, 1290, 1318, 1317, 1320, 1323, 1333 or a corresponding position thereof. In some embodiments, the SpCas9 variant comprises an amino acid substitution at position 1114, 1131, 1135, 1150, 1156, 1180, 1191, 1218, 1219, 1221, 1227, 1249, 1253, 1286, 1293, 1320, 1321, 1332, 1335, 1339 or a corresponding position thereof. In some embodiments, the SpCas9 variant comprises an amino acid substitution at position 1114, 1127, 1135, 1180, 1207, 1219, 1234, 1286, 1301, 1332, 1335, 1337, 1338, 1349 or a corresponding position thereof. Exemplary amino acid substitutions and PAM specificity of SpCas9 variants are shown in Tables 3A-3D.

TABLE 3A

SpCas9 amino acid position

| SpCas9 | 1114 R | 1135 D | 1218 G | 1219 E | 1221 Q | 1249 P | 1320 A | 1321 P | 1323 A | 1332 D | 1333 R | 1335 R | 1337 T |
|---|---|---|---|---|---|---|---|---|---|---|---|---|---|
| AAA | | N | | V | H | | | | | | G | | |
| AAA | | N | | V | H | | | | | | G | | |
| AAA | | | | V | | | | | | | G | | |
| TAA | G | N | | V | | | | | | | I | | |
| TAA | | N | | V | | | | | | | I | | A |
| TAA | G | N | | V | | | | | | | I | | A |
| CAA | | | | V | | | | | | | K | | |
| CAA | | N | | V | | | | | | | K | | |
| CAA | | N | | V | | | | | | | K | | |
| GAA | | | | V | H | | V | | | | K | | |
| GAA | | N | | V | | | V | | | | K | | |
| GAA | | | | V | H | | V | | | | K | | |
| TAT | | | S | V | H | S | | S | | | L | | |
| TAT | | | S | V | H | S | | S | | | L | | |
| TAT | | | S | V | H | S | | S | | | L | | |
| GAT | | | | V | | | | | | | I | | |
| GAT | | | | V | | | | | D | | Q | | |
| GAT | | | | V | | | | | D | | Q | | |
| CAC | | | | V | | | | | | N | Q | | N |
| CAC | | N | | V | | | | | | | Q | | N |
| CAC | | | | V | | | | | | N | Q | | N |

TABLE 3B

SpCas9 amino acid position

| SpCas9 | 1114 R | 1134 F | 1135 D | 1137 P | 1139 V | 1151 K | 1180 D | 1188 K | 1211 K | 1219 E | 1221 Q | 1256 Q | 1264 H | 1290 V | 1318 L | 1317 N | 1320 A | 1323 A | 1333 R |
|---|---|---|---|---|---|---|---|---|---|---|---|---|---|---|---|---|---|---|---|
| GAA | | | | | | | | | | V | H | | | | | | V | | K |
| GAA | | | N | S | | | | | | V | | | | | | | V | D | K |
| GAA | | | N | | | | | | | V | H | | Y | | | | V | | K |
| CAA | | | N | | | | | | | V | H | | Y | | | | V | | K |
| CAA | G | | N | S | | | | | | V | H | | Y | | | | V | | K |
| CAA | | | N | | | | | R | | V | H | | | | | | V | | K |
| CAA | | | N | | | | G | | R | V | H | | Y | | | | V | | K |
| CAA | | | N | | | | | | | V | H | | Y | | | | V | | K |
| AAA | | | N | | | | G | | | V | H | R | Y | | | | V | D | K |
| CAA | G | | N | | | | G | | | V | H | | Y | | | | V | D | K |
| CAA | | L | N | | | | G | | | V | H | | Y | | | T | V | D | K |
| TAA | G | | N | | | | G | | | V | H | | Y | G | S | | V | D | K |
| TAA | G | | N | | | E | G | | | V | H | | Y | | S | | V | | K |
| TAA | G | | N | | | | G | | | V | H | | Y | | S | | V | D | K |
| TAA | G | | N | | | | G | | R | V | H | | | | | | V | | K |
| TAA | | | N | | | | G | | R | V | H | | Y | | | | V | | K |
| TAA | G | | N | | A | | G | | | V | H | | | | | | V | | K |
| TAA | G | | N | | | | | | | V | H | | | | | | V | | K |

TABLE 3C

SpCas9 amino acid position

| SpCas9 | 1114 R | 1131 Y | 1135 D | 1150 E | 1156 K | 1180 D | 1191 K | 1218 G | 1219 E | 1221 Q |
|---|---|---|---|---|---|---|---|---|---|---|
| SacB.TAT | | | N | | | | N | | V | H |
| SacB.TAT | | | N | | | | | S | V | H |

TABLE 3C-continued

| | | | | | | | | | |
|---|---|---|---|---|---|---|---|---|---|
| AAT | | | N | | | | S | V | H |
| TAT | G | | N | | | G | S | V | H |
| TAT | G | | N | | | G | S | V | H |
| TAT | G | C | N | | | G | S | V | H |
| TAT | G | C | N | | | G | S | V | H |
| TAT | G | C | N | | | G | S | V | H |
| TAT | G | C | N | | E | G | S | V | H |
| TAT | G | C | N | V | | G | S | V | H |
| TAT | | C | N | | | G | S | V | H |
| TAT | G | C | N | | | G | S | V | H |

| | SpCas9 amino acid position | | | | | | | | | |
|---|---|---|---|---|---|---|---|---|---|---|
| | 1227 | 1249 | 1253 | 1286 | 1293 | 1320 | 1321 | 1332 | 1335 | 1339 |
| SpCas9 | A | P | E | N | A | A | P | D | R | T |
| SacB.TAT | | | | | | V | S | | L | |
| SacB.TAT | | S | | | | | S | G | L | |
| AAT | V | S | | K | T | | S | G | L | I |
| TAT | | S | K | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |

TABLE 3D

| | SpCas9 amino acid position | | | | | | | | | | | | | |
|---|---|---|---|---|---|---|---|---|---|---|---|---|---|---|
| | 1114 | 1127 | 1135 | 1180 | 1207 | 1219 | 1234 | 1286 | 1301 | 1332 | 1335 | 1337 | 1338 | 1349 |
| SpCas9 | R | D | D | D | E | E | N | N | P | D | R | T | S | H |
| SacB.CAC | | | N | | | V | | | | N | Q | N | | |
| AAC | G | | N | | | V | | | | N | Q | N | | |
| AAC | G | | N | | | V | | | | N | Q | N | | |
| TAC | G | | N | | | V | | | | N | Q | N | | |
| TAC | G | | N | | | V | | H | | N | Q | N | | |
| TAC | G | | N | | G | V | D | H | | N | Q | N | | |
| TAC | G | | N | | | V | | | | N | Q | N | | |
| TAC | G | G | N | E | | V | | H | | N | Q | N | | |
| TAC | G | | N | | | V | | H | | N | Q | N | | |
| TAC | G | | N | | | V | | | | N | Q | N | T | R |

In some embodiments, the Cas9 is a *Neisseria meningitidis* Cas9 (NmeCas9) or a variant thereof. In some embodiments, the NmeCas9 has specificity for a NNNNGAYW PAM, wherein Y is C or T and W is A or T. In some embodiments, the NmeCas9 has specificity for a NNNNGYTT PAM, wherein Y is C or T. In some embodiments, the NmeCas9 has specificity for a NNNNGTCT PAM. In some embodiments, the NmeCas9 is a Nme1 Cas9. In some embodiments, the NmeCas9 has specificity for a NNNNGATT PAM, a NNNNCCTA PAM, a NNNNCCTC PAM, a NNNNCCTT PAM, a NNNNCCTG PAM, a NNNNCCGT PAM, a NNNNCCGGPAM, a NNNNCCCA PAM, a NNNNCCCT PAM, a NNNNCCCC PAM, a NNNNCCAT PAM, a NNNNCCAG PAM, a NNNNCCAT PAM, or a NNNGATT PAM. In some embodiments, the Nme1Cas9 has specificity for a NNNNGATT PAM, a NNNNCCTA PAM, a NNNNCCTC PAM, a NNNNCCTT PAM, or a NNNNCCTG PAM. In some embodiments, the NmeCas9 has specificity for a CAA PAM, a CAAA PAM, or a CCA PAM. In some embodiments, the NmeCas9 is a Nme2 Cas9. In some embodiments, the NmeCas9 has specificity for a NNNNCC (N4CC) PAM, wherein N is any one of A, G, C, or T. in some embodiments, the NmeCas9 has specificity for a NNNNCCGT PAM, a NNNNCCGGPAM, a NNNNCCCA PAM, a NNNNCCCT PAM, a NNNNCCCC PAM, a NNNNCCAT PAM, a NNNNCCAG PAM, a NNNNCCAT PAM, or a NNNGATT PAM. In some embodiments, the NmeCas9 is a Nme3Cas9. In some embodiments, the NmeCas9 has specificity for a NNNNCAAA PAM, a NNNNCC PAM, or a NNNNCNNN PAM. Additional NmeCas9 features and PAM sequences as described in Edraki et al. Mol. Cell. (2019) 73(4): 714-726 is incorporated herein by reference in its entirety.

An exemplary *Neisseria meningitidis* Cas9 protein, Nme1Cas9, (NCBI Reference: WP_002235162.1; type II CRISPR RNA-guided endonuclease Cas9) has the following amino acid sequence:

```
   1 MAAFKPNPIN YILGLDIGIA SVGWAMVEID EDENPICLID LGVRVFERAE VPKTGDSLAM

61 ARRLARSVRR LTRRRAHRLL RARRLLKREG VLQAADFDEN GLIKSLPNTP WQLRAAALDR

121 KLTPLEWSAV LLHLIKHRGY LSQRKNEGET ADKELGALLK GVADNAHALQ TGDFRTPAEL

181 ALNKFEKESG HIRNQRGDYS HTFSRKDLQA ELILLFEKQK EFGNPHVSGG LKEGIETLLM

241 TQRPALSGDA VQKMLGHCTF EPAEPKAAKN TYTAERFIWL TKLNNLRILE QGSERPLTDT

301 ERATLMDEPY RKSKLTYAQA RKLLGLEDTA FFKGLRYGKD NAEASTLMEM KAYHAISEAL

361 EKEGLKDKKS PLNLSPELQD EIGTAFSLFK TDEDITGRLK DRIQPEILEA LLKHISFDKF

421 VQISLKALRR IVPLMEQGKR YDEACAEIYG DHYGKKNTEE KIYLPPIPAD EIRNPVVLRA

481 LSQARKVING VVRRYGSPAR IHIETAREVG KSFKDRKEIE KRQEENRKDR EKAAAKFREY

541 FPNFVGEPKS KDILKLRLYE QQHGKCLYSG KEINLGRLNE KGYVEIDHAL PFSRTWDDSF

601 NNKVLVIGSE NQNKGNQTPY EYFNGKDNSR EWQEFKARVE TSRFPRSKKQ RILLQKFDED

661 GFKERNLNDT RYVNRFLCQF VADRMRLTGK GKKRVFASNG QITNLLRGFW GLRKVRAEND

721 RHHALDAVVV ACSTVAMQQK ITRFVRYKEM NAFDGKTIDK ETGEVLHQKT HFPQPWEFFA

781 QEVMIRVFGK PDGKPEFEEA DTPEKLRTLL AEKLSSRPEA VHEYVTPLFV SRAPNRKMSG

841 QGHMETVKSA KRLDEGVSVL RVPLTQLKLK DLEKMVNRER EPKLYEALKA RLEAHKDDPA

901 KAFAEPFYKY DKAGNRTQQV KAVRVEQVQK TGVWVRNHNG IADNATMVRV DVFEKGDKYY

961 LVPIYSWQVA KGILPDRAVV QGKDEEDWQL IDDSFNFKFS LHPNDLVEVI TKKARMFGYF

1021 ASCHRGTGNI NIRIHDLDHK IGKNGILEGI GVKTALSFQK YQIDELGKEI RPCRLKKRPP

1081 VR
```

An exemplary *Neisseria meningitidis* Cas9 protein, Nme2Cas9, (NCBI Reference: WP_002230835; type II CRISPR RNA-guided endonuclease Cas9) has the following amino acid sequence:

```
   1   MAAFKPNPIN YILGLDIGIA SVGWAMVEID EEENPIRLID LGVRVFERAE VPKTGDSLAM

61   ARRLARSVRR LTRRRAHRLL RARRLLKREG VLQAADFDEN GLIKSLPNTP WQLRAAALDR

121   KLTPLEWSAV LLHLIKHRGY LSQRKNEGET ADKELGALLK GVANNAHALQ TGDFRTPAEL

181   ALNKFEKESG HIRNQRGDYS HTFSRKDLQA ELILLFEKQK EFGNPHVSGG LKEGIETLLM

241   TQRPALSGDA VQKMLGHCTF EPAEPKAAKN TYTAERFIWL TKLNNLRILE QGSERPLTDT

301   ERATLMDEPY RKSKLTYAQA RKLLGLEDTA FFKGLRYGKD NAEASTLMEM KAYHAISRAL

361   EKEGLKDKKS PLNLSSELQD EIGTAFSLFK TDEDITGRLK DRVQPEILEA LLKHISFDKF

421   VQISLKALRR IVPLMEQGKR YDEACAEIYG DHYGKKNTEE KIYLPPIPAD EIRNPVVLRA

481   LSQARKVING VVRRYGSPAR IHIETAREVG KSFKDRKEIE KRQEENRKDR EKAAAKFREY

541   FPNFVGEPKS KDILKLRLYE QQHGKCLYSG KEINLVRLNE KGYVEIDHAL PFSRTWDDSF

601   NNKVLVLGSE NQNKGNQTPY EYFNGKDNSR EWQEFKARVE TSRFPPSKKQ RILLQKFDED

661   GFKECNLDNT RYVNRFLCQF VADHILLTGK GKRRVFASNG QITNLLRGFW GLRKVRAEND

721   RHHALDAVVV ACSTVAMQQK ITRFVRYKEM NAFDGKTIDK ETGKVLHQKT HFPQPWEFFA

781   QEVMIRVFGK PDGKPEFEEA DTPEKLRTLL AEKLSSRPEA VHEYVTPLFV SRAPNRKMSG

841   AHKDTLRSAK RFVKHNEKIS VKRVWLTEIK LADLENMVNY KNGREIELYE ALKARLEAYG

901   GNAKQAFDPK DNPFYKKGGQ LVKAVRVEKT QESGVLLNKK NAYTIADNGD MVRVDVFCKV
```

-continued

```
 961   DKKGKNQYFI VPIYAWQVAE NILPDIDCKG YRIDDSYTFC FSLHKYDLIA FQKDEKSKVE

1021   FAYYINCDSS NGRFYLAWHD KGSKEQQFRI STQNVLVIQK YQVNELGKEI RPCRLKKRPP

1081   VR
```

Cas12 Domains of Nucleobase Editors

Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors, albeit different types (Type II and Type V, respectively). In addition to Cpf1, Class 2, Type V CRISPR-Cas systems also comprise Cas12a/Cpf1, Cas12b/C2cl, Cas12c/C2c3, Cas12d/CasY, Cas12e/CasX, Cas12g, Cas12h, Cas12i and Cas12j/CasΦ). See, e.g., Shmakov et al., "Discovery and Functional Characterization of Diverse Class 2 CRISPR Cas Systems," Mol. Cell, 2015 Nov. 5; 60(3): 385-397; Makarova et al., "Classification and Nomenclature of CRISPR-Cas Systems: Where from Here?" CRISPR Journal, 2018, 1(5): 325-336; and Yan et al., "Functionally Diverse Type V CRISPR-Cas Systems," Science, 2019 Jan. 4; 363: 88-91; the entire contents of each is hereby incorporated by reference. Type V Cas proteins contain a RuvC (or RuvC-like) endonuclease domain. While production of mature CRISPR RNA (crRNA) is generally tracrRNA-independent, Cas12b/C2c1, for example, requires tracrRNA for production of crRNA. Cas12b/C2c1 depends on both crRNA and tracrRNA for DNA cleavage.

Nucleic acid programmable DNA binding proteins contemplated in the present invention include Cas proteins that are classified as Class 2, Type V (Cas12 proteins). Non-limiting examples of Cas Class 2, Type V proteins include Cas12a/Cpf1, Cas12b/C2cl, Cas12c/C2c3, Cas12d/CasY, Cas12e/CasX, Cas12g, Cas12h, Cas12i, and Cas12j/CasΦ homologues thereof, or modified versions thereof. As used herein, a Cas12 protein can also be referred to as a Cas12 nuclease, a Cas12 domain, or a Cas12 protein domain. In some embodiments, the Cas12 proteins of the present invention comprise an amino acid sequence interrupted by an internally fused protein domain such as a deaminase domain.

In some embodiments, the Cas12 domain is a nuclease inactive Cas12 domain or a Cas12 nickase. In some embodiments, the Cas12 domain is a nuclease active domain. For example, the Cas12 domain may be a Cas12 domain that nicks one strand of a duplexed nucleic acid (e.g., duplexed DNA molecule). In some embodiments, the Cas12 domain comprises any one of the amino acid sequences as set forth herein. In some embodiments the Cas12 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas12 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth herein. In some embodiments, the Cas12 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas12 are provided. For example, in some embodiments, a protein comprises one of two Cas12 domains: (1) the gRNA binding domain of Cas12; or (2) the DNA cleavage domain of Cas12. In some embodiments, proteins comprising Cas12 or fragments thereof are referred to as "Cas12 variants." A Cas12 variant shares homology to Cas12, or a fragment thereof. For example, a Cas12 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas12. In some embodiments, the Cas12 variant may have 1, 2, 3, 4, 5, 6, 7, 8,9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas12. In some embodiments, the Cas12 variant comprises a fragment of Cas12 (e.g., a gRNA binding domain or a DNA cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas12. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas12. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas12 corresponds to, or comprises in part or in whole, a Cas12 amino acid sequence having one or more mutations that alter the Cas12 nuclease activity. Such mutations, by way of example, include amino acid substitutions within the RuvC nuclease domain of Cas12. In some embodiments, variants or homologues of Cas12 are provided which are at least about 70% identical, at least about 80% identical, at least about 90% identical, at least about 95% identical, at least about 98% identical, at least about 99% identical, at least about 99.5% identical, or at least about 99.9% identical to a wild type Cas12. In some embodiments, variants of Cas12 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas12 fusion proteins as provided herein comprise the full-length amino acid sequence of a Cas12 protein, e.g., one of the Cas12 sequences provided herein. In other embodiments, however, fusion proteins as provided herein do not comprise a full-length Cas12 sequence, but only one or more fragments thereof. Exemplary amino acid sequences of suitable Cas12 domains are provided herein, and additional suitable sequences of Cas12 domains and fragments will be apparent to those of skill in the art.

Generally, the class 2, Type V Cas proteins have a single functional RuvC endonuclease domain (See, e.g., Chen et al., "CRISPR-Cas12a target binding unleashes indiscriminate single-stranded DNase activity," Science 360:436-439 (2018)). In some cases, the Cas12 protein is a variant Cas12b protein. (See Strecker et al., Nature Communications, 2019, 10(1): Art. No.: 212). In one embodiment, a variant Cas12 polypeptide has an amino acid sequence that is different by 1, 2, 3, 4, 5 or more amino acids (e.g., has a deletion, insertion, substitution, fusion) when compared to the amino acid sequence of a wild type Cas12 protein. In some instances, the variant Cas12 polypeptide has an amino acid change (e.g., deletion, insertion, or substitution) that reduces the activity of the Cas12 polypeptide. For example, in some instances, the variant Cas12 is a Cas12b polypeptide that has less than 50%, less than 40%, less than 30%, less than 20%, less than 10%, less than 5%, or less than 1% of the nickase activity of the corresponding wild-type Cas12b protein. In some cases, the variant Cas12b protein has no substantial nickase activity.

In some cases, a variant Cas12b protein has reduced nickase activity. For example, a variant Cas12b protein exhibits less than about 20%, less than about 15%, less than about 10%, less than about 5%, less than about 1%, or less than about 0.1%, of the nickase activity of a wild-type Cas12b protein.

In some embodiments, the Cas12 protein includes RNA-guided endonucleases from the Cas12a/Cpf1 family that displays activity in mammalian cells. CRISPR from *Prevotella* and *Francisella* 1 (CRISPR/Cpf1) is a DNA editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1, unlike Cas9, does not have a HNH endonuclease domain, and the N-terminal of Cpf1 does not have the alpha-helical recognition lobe of Cas9. Cpf1 CRISPR- Cas domain architecture shows that Cpf1 is functionally unique, being classified as Class 2, type V CRISPR system. The Cpf1 loci encode Cas1, Cas2, and Cas4 proteins are more similar to types I and III than type II systems. Functional Cpf1 does not require the trans-activating CRISPR RNA (tracrRNA), therefore, only CRISPR (crRNA) is required. This benefits genome editing because Cpf1 is not only smaller than Cas9, but also it has a smaller sgRNA molecule (approximately half as many nucleotides as Cas9). The Cpf1-crRNA complex cleaves target DNA or RNA by identification of a protospacer adjacent motif 5'-YTN-3' or 5'-TTTN-3' in contrast to the G-rich PAM targeted by Cas9. After identification of PAM, Cpf1 introduces a sticky-end-like DNA double-stranded break having an overhang of 4 or 5 nucleotides.

In some aspects of the present invention, a vector encodes a CRISPR enzyme that is mutated to with respect to a corresponding wild-type enzyme such that the mutated CRISPR enzyme lacks the ability to cleave one or both strands of a target polynucleotide containing a target sequence can be used. Cas12 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild type exemplary Cas12 polypeptide (e.g., Cas12 from *Bacillus hisashii*). Cas12 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild type exemplary Cas12 polypeptide (e.g., from *Bacillus hisashii* (BhCas12b), *Bacillus* sp. V3-13 (BvCas12b), and *Alicyclobacillus acidiphilus* (AaCas12b)). Cas12 can refer to the wild type or a modified form of the Cas12 protein that can comprise an amino acid change such as a deletion, insertion, substitution, variant, mutation, fusion, chimera, or any combination thereof.

In some embodiments, BhCas12b guide polynucleotide has the following sequence:

```
BhCas12b sgRNA scaffold (underlined) + 20 nt to
23 nt guide sequence (denoted by Nₙ)
5'GUUCUGUCUUUUGGUCAGGACAACCGUCUAGCUAUAAGUGCUGCAGG
GUGUGAGAAACUCCUAUUGCUGGACGAUGUCUCUUACGAGGCAUUAGCA
CNNNNNNNNNNNNNNNNNNNNNNN 3'
```

In some embodiments, BvCas12b and AaCas12b guide polynucleotides have the following sequences:

```
BvCas12b sgRNA scaffold (underlined) + 20 nt to
23 nt guide sequence (denoted by Nₙ)
5'GACCUAUAGGGUCAAUGAAUCUGUGCGUGUGCCAUAAGUAAUUAAAA
AUUACCCACCACAGGAGCACCUGAAAACAGGUGCUUGGCACNNNNNNNNN
NNNNNNNNNNNNN-3'
```

```
AaCas12b sgRNA scaffold (underlined) + 20 nt to
23 nt guide sequence (denoted by Nₙ)
5'GUCUAAAGGACAGAAUUUUUCAACGGGUGUGCCAAUGGCCACUUUCC
AGGUGGCAAAGCCCGUUGAACUUCUCAAAAAGAACGAUCUGAGAAGUGG
CACNNNNNNNNNNNNNNNNNNNNNNN-3'
```

Nucleic Acid Programmable DNA Binding Proteins

Some aspects of the disclosure provide fusion proteins comprising domains that act as nucleic acid programmable DNA binding proteins, which may be used to guide a protein, such as a base editor, to a specific nucleic acid (e.g., DNA or RNA) sequence. In particular embodiments, a fusion protein comprises a nucleic acid programmable DNA binding protein domain and a deaminase domain. Non-limiting examples of nucleic acid programmable DNA binding proteins include, Cas9 (e.g., dCas9 and nCas9), Cas12a/Cpf1, Cas12b/C2cl, Cas12c/C2c3, Cas12d/CasY, Cas12e/CasX, Cas12g, Cas12h, Cas12i and Cas12j/CasΦ. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2cl, Cas12c/C2c3, Cas12d/CasY, Cas12e/CasX, Cas12g, Cas12h, Cas12i, Cas12j/CasΦ, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" CRISPR J. 2018 October; 1:325-336. doi: 10.1089/crispr.2018.0033; Yan et al., "Functionally diverse type V CRISPR-Cas systems" Science. 2019 Jan. 4; 363(6422):88-91. doi: 10.1126/science.aav7271, the entire contents of each are hereby incorporated by reference.

One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

Useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., *Cell,* 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A. It should be appreciated that Cpf1 from other bacterial species may also be used in accordance with the present disclosure.

Wild-type *Francisella novicida* Cpf1 (D917, E1006, and D1255 are bolded and underlined)

MSIYQEFVNKYSLSKTLRFELIPQGKTLENIKARGLILDDEKRAKDYKKAKQIIDKYHQFFIEE

ILSSVCISEDLLQNYSDVYFKLKKSDDDNLQKDFKSAKDTIKKQISEYIKDSEKFKNLFNQNLI

DAKKGQESDLILWLKQSKDNGIELFKANSDITDIDEALEIIKSFKGWTTYFKGFHENRKNVYSS

NDIPTSIIYRIVDDNLPKFLENKAKYESLKDKAPEAINYEQIKKDLAEELTFDIDYKTSEVNQR

VFSLDEVFEIANFNNYLNQSGITKFNTIIGGKFVNGENTKRKGINEYINLYSQQINDKTLKKYK

MSVLFKQILSDTESKSFVIDKLEDDSDVVTTMQSFYEQIAAFKTVEEKSIKETLSLLFDDLKAQ

KLDLSKIYFKNDKSLTDLSQQVFDDYSVIGTAVLEYITQQIAPKNLDNPSKKEQELIAKKTEKA

KYLSLETIKLALEEFNKHRDIDKQCRFEEILANFAAIPMIFDEIAQNKDNLAQISIKYQNQGKK

DLLQASAEDDVKAIKDLLDQTNNLLHKLKIFHISQSEDKANILDKDEHFYLVFEECYFELANIV

PLYNKIRNYITQKPYSDEKFKLNFENSTLANGWDKNKEPDNTAILFIKDDKYYLGVMNKKNNKI

FDDKAIKENKGEGYKKIVYKLLPGANKMLPKVFFSAKSIKFYNPSEDILRIRNHSTHTKNGSPQ

KGYEKFEFNIEDCRKFIDFYKQSISKHPEWKDFGFRFSDTQRYNSIDEFYREVENQGYKLTFEN

-continued

ISESYIDSVVNQGKLYLFQIYNKDFSAYSKGRPNLHTLYWKALFDERNLQDVVYKLNGEAELFY

RKQSIPKKITHPAKEAIANKNKDNPKKESVFEYDLIKDKRFTEDKFFFHCPITINFKSSGANKF

NDEINLLLKEKANDVHILSIDRGERHLAYYTLVDGKGNIIKQDTFNIIGNDRMKTNYHDKLAAI

EKDRDSARKDWKKINNIKEMKEGYLSQVVHEIAKLVIEYNAIVVFEDLNFGFKRGRFKVEKQVY

QKLEKMLIEKLNYLVFKDNEFDKTGGVLRAYQLTAPFETFKKMGKQTGIIYYVPAGFTSKICPV

TGFVNQLYPKYESVSKSQEFFSKFDKICYNLDKGYFEFSFDYKNFGDKAAKGKWTIASFGSRLI

NFRNSDKNHNWDTREVYPTKELEKLLKDYSIEYGHGECIKAAICGESDKKFFAKLTSVLNTILQ

MRNSKTGTELDYLISPVADVNGNFFDSRQAPKNMPQDADANGAYHIGLKGLMLLGRIKNNQEGK

KLNLVIKNEEYFEFVQNRNN

*Francisella novicida* Cpf1 D917A (A917, E1006, and D1255 are bolded and underlined)
MSIYQEFVNKYSLSKTLRFELIPQGKTLENIKARGLILDDEKRAKDYKKAKQIIDKYHQFFIEE

ILSSVCISEDLLQNYSDVYFKLKKSDDDNLQKDFKSAKDTIKKQISEYIKDSEKFKNLFNQNLI

DAKKGQESDLILWLKQSKDNGIELFKANSDITDIDEALEIIKSFKGWTTYFKGFHENRKNVYSS

NDIPTS11YRIVDDNLPKFLENKAKYESLKDKAPEAINYEQIKKDLAEELTFDIDYKTSEVNQR

VFSLDEVFEIANFNNYLNQSGITKFNTIIGGKFVNGENTKRKGINEYINLYSQQINDKTLKKYK

MSVLFKQILSDTESKSFVIDKLEDDSDVVTTMQSFYEQIAAFKTVEEKSIKETLSLLFDDLKAQ

KLDLSKIYFKNDKSITDLSQQVFDDYSVIGTAVLEYITQQIAPKNLDNPSKKEQELIAKKTEKA

KYLSLETIKLALEEFNKHRDIDKQCRFEEILANFAAIPMIFDEIAQNKDNLAQISIKYQNQGKK

DLLQASAEDDVKAIKDLLDQTNNLLHKLKIFHISQSEDKANILDKDEHFYLVFEECYFELANIV

PLYNKIRNYITQKPYSDEKFKLNFENSTLANGWDKNKEPDNTAILFIKDDKYYLGVMNKKNNKI

FDDKAIKENKGEGYKKIVYKLLPGANKMLPKVFFSAKSIKFYNPSEDILRIRNHSTHTKNGSPQ

KGYEKFEFNIEDCRKFIDFYKQSISKHPEWKDFGFRFSDTQRYNSIDEFYREVENQGYKLTFEN

ISESYIDSVVNQGKLYLFQIYNKDFSAYSKGRPNLHTLYWKALFDERNLQDVVYKLNGEAELFY

RKQSIPKKITHPAKEAIANKNKDNPKKESVFEYDLIKDKRFTEDKFFFHCPITINFKSSGANKF

NDEINLLLKEKANDVHILSIARGERHLAYYTLVDGKGNIIKQDTFNIIGNDRMKTNYHDKLAAI

EKDRDSARKDWKKINNIKEMKEGYLSQVVHEIAKLVIEYNAIVVFEDLNFGFKRGRFKVEKQVY

QKLEKMLIEKLNYLVFKDNEFDKTGGVLRAYQLTAPFETFKKMGKQTGIIYYVPAGFTSKICPV

TGFVNQLYPKYESVSKSQEFFSKFDKICYNLDKGYFEFSFDYKNFGDKAAKGKWTIASFGSRLI

NFRNSDKNHNWDTREVYPTKELEKLLKDYSIEYGHGECIKAAICGESDKKFFAKLTSVLNTILQ

MRNSKTGTELDYLISPVADVNGNFFDSRQAPKNMPQDADANGAYHIGLKGLMLLGRIKNNQEGK

KLNLVIKNEEYFEFVQNRNN

*Francisella novicida* Cpf1 E1006A (D917, A1006, and D1255 are bolded and underlined)
MSIYQEFVNKYSLSKTLRFELIPQGKTLENIKARGLILDDEKRAKDYKKAKQIIDKYHQFFIEE

ILSSVCISEDLLQNYSDVYFKLKKSDDDNLQKDFKSAKDTIKKQISEYIKDSEKFKNLFNQNLI

DAKKGQESDLILWLKQSKDNGIELFKANSDITDIDEALEIIKSFKGWTTYFKGFHENRKNVYSS

NDIPTSIIYRIVDDNLPKFLENKAKYESLKDKAPEAINYEQIKKDLAEELTFDIDYKTSEVNQR

VFSLDEVFEIANFNNYLNQSGITKFNTIIGGKFVNGENTKRKGINEYINLYSQQINDKTLKKYK

MSVLFKQILSDTESKSFVIDKLEDDSDVVTTMQSFYEQIAAFKTVEEKSIKETLSLLFDDLKAQ

KLDLSKIYFKNDKSLTDLSQQVFDDYSVIGTAVLEYITQQIAPKNLDNPSKKEQELIAKKTEKA

KYLSLETIKLALEEFNKHRDIDKQCRFEEILANFAAIPMIFDEIAQNKDNLAQISIKYQNQGKK

DLLQASAEDDVKAIKDLLDQTNNLLHKLKIFHISQSEDKANILDKDEHFYLVFEECYFELANIV

PLYNKIRNYITQKPYSDEKFKLNFENSTLANGWDKNKEPDNTAILFIKDDKYYLGVMNKKNNKI

FDDKAIKENKGEGYKKIVYKLLPGANKMLPKVFFSAKSIKFYNPSEDILRIRNHSTHTKNGSPQ

KGYEKFEFNIEDCRKFIDFYKQSISKHPEWKDFGFRFSDTQRYNSIDEFYREVENQGYKLTFEN

ISESYIDSVVNQGKLYLFQIYNKDFSAYSKGRPNLHTLYWKALFDERNLQDVVYKLNGEAELFY

RKQSIPKKITHPAKEAIANKNKDNPKKESVFEYDLIKDKRFTEDKFFFHCPITINFKSSGANKF

NDEINLLLKEKANDVHILSIDRGERHLAYYTLVDGKGNIIKQDTFNIIGNDRMKTNYHDKLAAI

EKDRDSARKDWKKINNIKEMKEGYLSQVVHEIAKLVIEYNAIVVFADLNFGFKRGRFKVEKQVY

QKLEKMLIEKLNYLVFKDNEFDKTGGVLRAYQLTAPFETFKKMGKQTGIIYYVPAGFTSKICPV

TGFVNQLYPKYESVSKSQEFFSKFDKICYNLDKGYFEFSFDYKNFGDKAAKGKWTTASFGSRDI

NFRNSDKNHNWDTREVYPTKELEKLLKDYSIEYGHGECIKAAICGESDKKFFAKLTSVLNTILQ

MRNSKTGTELDYLISPVADVNGNFFDSRQAPKNMPQDADANGAYHIGLKGLMLLGRIKNNQEGK

KLNLVIKNEEYFEFVQNRNN

*Francisella novicida* Cpf1 D1255A (D917, E1006, and A1255 are bolded and underlined)
MSIYQEFVNKYSLSKTLRFELIPQGKTLENIKARGLILDDEKRAKDYKKAKQIIDKYHQFFIEE

ILSSVCISEDLLQNYSDVYFKLKKSDDDNLQKDFKSAKDTIKKQISEYIKDSEKFKNLFNQNLI

DAKKGQESDLILWLKQSKDNGIELFKANSDITDIDEALEIIKSFKGWTTYFKGFHENRKNVYSS

NDIPTSIIYRIVDDNLPKFLENKAKYESLKDKAPEAINYEQIKKDLAEELTFDIDYKTSEVNQR

VFSLDEVFEIANFNNYLNQSGITKFNTIIGGKFVNGENTKRKGINEYINLYSQQINDKTLKKYK

MSVLFKQILSDTESKSFVIDKLEDDSDVVTTMQSFYEQIAAFKTVEEKSIKETLSLLFDDLKAQ

KLDLSKIYFKNDKSLTDLSQQVFDDYSVIGTAVLEYITQQIAPKNLDNPSKKEQELIAKKTEKA

KYLSLETIKLALEEFNKHRDIDKQCRFEEILANFAAIPMIFDEIAQNKDNLAQISIKYQNQGKK

DLLQASAEDDVKAIKDLLDQTNNLLHKLKIFHISQSEDKANILDKDEHFYLVFEECYFELANIV

PLYNKIRNYITQKPYSDEKFKLNFENSTLANGWDKNKEPDNTAILFIKDDKYYLGVMNKKNNKI

FDDKAIKENKGEGYKKIVYKLLPGANKMLPKVFFSAKSIKFYNPSEDILRIRNHSTHTKNGSPQ

KGYEKFEFNIEDCRKFIDFYKQSISKHPEWKDFGFRFSDTQRYNSIDEFYREVENQGYKLTFEN

ISESYIDSVVNQGKLYLFQIYNKDFSAYSKGRPNLHTLYWKALFDERNLQDVVYKLNGEAELFY

RKQSIPKKITHPAKEAIANKNKDNPKKESVFEYDLIKDKRFTEDKFFFHCP1T1NFKSSGANKF

NDEINLLLKEKANDVHILSIDRGERHLAYYTLVDGKGNIIKQDTFNIIGNDRMKTNYHDKLAAI

EKDRDSARKDWKKINNIKEMKEGYLSQVVHEIAKLVIEYNAIVVFEDLNFGFKRGRFKVEKQVY

QKLEKMLIEKLNYLVFKDNEFDKTGGVLRAYQLTAPFETFKKMGKQTGIIYYVPAGFTSKICPV

TGFVNQLYPKYESVSKSQEFFSKFDKICYNLDKGYFEFSFDYKNFGDKAAKGKWTIASFGSRLI

NFRNSDKNHNWDTREVYPTKELEKLLKDYSIEYGHGECIKAAICGESDKKFFAKLTSVLNTILQ

MRNSKTGTELDYLISPVADVNGNFFDSRQAPKNMPQDAAANGAYHIGLKGLMLLGRIKNNQEGK

KLNLVIKNEEYFEFVQNRNN

*Francisella novicida* Cpf1 D917A/E1006A (A917, A1006, and D1255 are bolded and underlined)
MSIYQEFVNKYSLSKTLRFELIPQGKTLENIKARGLILDDEKRAKDYKKAKQIIDKYHQFFIEE

ILSSVCISEDLLQNYSDVYFKLKKSDDDNLQKDFKSAKDTIKKQISEYIKDSEKFKNLFNQNLI

DAKKGQESDTTTWTKQSKDNGTELFKANSDITDTDEALETTKSFKGWTTYFKGFHENRKNVYSS

NDIPTSIIYRIVDDNLPKFLENKAKYESLKDKAPEAINYEQIKKDLAEELTFDIDYKTSEVNQR

VFSLDEVFEIANFNNYLNQSGITKFNTIIGGKFVNGENTKRKGINEYINLYSQQINDKTLKKYK

MSVLFKQILSDTESKSFVIDKLEDDSDVVTTMQSFYEQIAAFKTVEEKSIKETLSLLFDDLKAQ

-continued

KLDLSKIYFKNDKSLTDLSQQVFDDYSVIGTAVLEYITQQIAPKNLDNPSKKEQELIAKKTEKA

KYLSLETIKLALEEFNKHRDIDKQCRFEEILANFAAIPMIFDEIAQNKDNLAQISIKYQNQGKK

DLLQASAEDDVKAIKDLLDQTNNLLHKLKIFHISQSEDKANILDKDEHFYLVFEECYFELANIV

PLYNKIRNYITQKPYSDEKFKLNFENSTLANGWDKNKEPDNTAILFIKDDKYYLGVMNKKNNKI

FDDKAIKENKGEGYKKIVYKLLPGANKMLPKVFFSAKSIKFYNPSEDILRIRNHSTHTKNGSPQ

KGYEKFEFNIEDCRKFIDFYKQSISKHPEWKDFGFRFSDTQRYNSIDEFYREVENQGYKLTFEN

ISESYIDSVVNQGKLYLFQIYNKDFSAYSKGRPNLHTLYWKALFDERNLQDVVYKLNGEAELFY

RKQSIPKKITHPAKEAIANKNKDNPKKESVFEYDLIKDKRFTEDKFFFHCPITINFKSSGANKF

NDEINLLLKEKANDVHILSIARGERHLAYYTLVDGKGNIIKQDTFNIIGNDRMKTNYHDKLAAI

EKDRDSARKDWKKINNIKEMKEGYLSQVVHEIAKLVIEYNAIVVFADLNFGFKRGRFKVEKQVY

QKLEKMLIEKLNYLVFKDNEFDKTGGVLRAYQLTAPFETFKKMGKQTGIIYYVPAGFTSKICPV

TGFVNQLYPKYESVSKSQEFFSKFDKICYNLDKGYFEFSFDYKNFGDKAAKGKWTIASFGSRLI

NFRNSDKNHNWDTREVYPTKELEKLLKDYSIEYGHGECIKAAICGESDKKFFAKLTSVLNTILQ

MRNSKTGTELDYLISPVADVNGNFFDSRQAPKNMPQDADANGAYHIGLKGLMLLGRIKNNQEGK

KLNLVIKNEEYFEFVQNRNN

*Franciscella novicida* Cpf1 D917A/D1255A (A917, E1006, and A1255 are bolded and underlined)
MSIYQEFVNKYSLSKTLRFELIPQGKTLENIKARGLILDDEKRAKDYKKAKQIIDKYHQFFIEE

ILSSVCISEDLLQNYSDVYFKLKKSDDDNLQKDFKSAKDTIKKQISEYIKDSEKFKNLFNQNLI

DAKKGQESDLILWLKQSKDNGIELFKANSDITDIDEALEIIKSFKGWTTYFKGFHENRKNVYSS

NDIPTSIIYRIVDDNLPKFLENKAKYESLKDKAPEAINYEQIKKDLAEELTFD1DYKTSEVNQR

VFSLDEVFEIANFNNYLNQSGITKFNTIIGGKFVNGENTKRKGINEYINLYSQQINDKTLKKYK

MSVLFKQILSDTESKSFVIDKLEDDSDVVTTMQSFYEQIAAFKTVEEKSIKETLSLLFDDLKAQ

KLDLSKIYFKNDKSLTDLSQQVFDDYSVIGTAVLEYITQQIAPKNLDNPSKKEQELIAKKTEKA

KYLSLETIKLALEEFNKHRDIDKQCRFEEILANFAAIPMIFDEIAQNKDNLAQISIKYQNQGKK

DLLQASAEDDVKAIKDLLDQTNNLLHKLKIFHISQSEDKANILDKDEHFYLVFEECYFELANIV

PLYNKIRNYITQKPYSDEKFKLNFENSTLANGWDKNKEPDNTAILFIKDDKYYLGVMNKKNNKI

FDDKAIKENKGEGYKKIVYKLLPGANKMLPKVFFSAKSIKFYNPSEDILRIRNHSTHTKNGSPQ

KGYEKFEFNIEDCRKFIDFYKQSISKHPEWKDFGFRFSDTQRYNSIDEFYREVENQGYKLTFEN

ISESYIDSVVNQGKLYLFQIYNKDFSAYSKGRPNLHTLYWKALFDERNLQDVVYKLNGEAELFY

RKQSIPKKITHPAKEAIANKNKDNPKKESVFEYDLIKDKRFTEDKFFFHCPITINFKSSGANKF

NDEINLLLKEKANDVHILSIARGERHLAYYTLVDGKGNIIKQDTFNIIGNDRMKTNYHDKLAAI

EKDRDSARKDWKKINNIKEMKEGYLSQVVHEIAKLVIEYNAIVVFEDLNFGFKRGRFKVEKQVY

QKLEKMLIEKLNYLVFKDNEFDKTGGVLRAYQLTAPFETFKKMGKQTGIIYYVPAGFTSKICPV

TGFVNQLYPKYESVSKSQEFFSKFDKICYNLDKGYFEFSFDYKNFGDKAAKGKWTIASFGSRLI

NFRNSDKNHNWDTREVYPTKELEKLLKDYSIEYGHGECIKAAICGESDKKFFAKLTSVLNTILQ

MRNSKTGTELDYLISPVADVNGNFFDSRQAPKNMPQDAAANGAYHIGLKGLMLLGRIKNNQEGK

KLNLVIKNEEYFEFVQNRNN

*Franciscella novicida* Cpf1 E1006A/D1255A (D917, A1006, and A1255 are bolded and underlined)
MSIYQEFVNKYSLSKTLRFELIPQGKTLENIKARGLILDDEKRAKDYKKAKQIIDKYHQFFIEE

ILSSVCISEDLLQNYSDVYFKLKKSDDDNLQKDFKSAKDTIKKQISEYIKDSEKFKNLFNQNLI

-continued

DAKKGQESDLILWLKQSKDNGIELFKANSDITDIDEALEIIKSFKGWTTYFKGFHENRKNVYSS

NDIPTSIIYRIVDDNLPKFLENKAKYESLKDKAPEAINYEQIKKDLAEELTFDIDYKTSEVNQR

VFSLDEVFEIANFNNYLNQSGITKFNTIIGGKFVNGENTKRKGINEYINLYSQQINDKTLKKYK

MSVLFKQILSDTESKSFVIDKLEDDSDVVTTMQSFYEQIAAFKTVEEKSIKETLSLLFDDLKAQ

KLDLSKIYFKNDKSLTDLSQQVFDDYSVIGTAVLEYITQQIAPKNLDNPSKKEQELIAKKTEKA

KYLSLETIKLALEEFNKHRDIDKQCRFEEILANFAAIPMIFDEIAQNKDNLAQISIKYQNQGKK

DLLQASAEDDVKAIKDLLDQTNNLLHKLKIFHISQSEDKANILDKDEHFYLVFEECYFELANIV

PLYNKIRNYITQKPYSDEKFKLNFENSTLANGWDKNKEPDNTAILFIKDDKYYLGVMNKKNNKI

FDDKAIKENKGEGYKKIVYKLLPGANKMLPKVFFSAKSIKFYNPSEDILRIRNHSTHTKNGSPQ

KGYEKFEFNIEDCRKFIDFYKQSISKHPEWKDFGFRFSDTQRYNSIDEFYREVENQGYKLTFEN

ISESYIDSVVNQGKLYLFQIYNKDFSAYSKGRPNLHTLYWKALFDERNLQDVVYKLNGEAELFY

RKQSIPKKITHPAKEAIANKNKDNPKKESVFEYDLIKDKRFTEDKFFFHCP1T1NFKSSGANKF

NDEINLLLKEKANDVHILSIDRGERHLAYYTLVDGKGNIIKQDTFNIIGNDRMKTNYHDKLAAI

EKDRDSARKDWKKINNIKEMKEGYLSQVVHEIAKLVIEYNAIVVFADLNFGFKRGRFKVEKQVY

QKLEKMLIEKLNYLVFKDNEFDKTGGVLRAYQLTAPFETFKKMGKQTGIIYYVPAGFTSKICPV

TGFVNQLYPKYESVSKSQEFFSKFDKICYNLDKGYFEFSFDYKNFGDKAAKGKWTIASFGSRLI

NFRNSDKNHNWDTREVYPTKELEKLLKDYSIEYGHGECIKAAICGESDKKFFAKLTSVLNTILQ

MRNSKTGTELDYLISPVADVNGNFFDSRQAPKNMPQDAAANGAYHIGLKGLMLLGRIKNNQEGK

KLNLVIKNEEYFEFVQNRNN

*Francisella novicida* Cpf1 D917A/E1006A/D1255A (A917, A1006, and A1255 are
bolded and underlined)
MSIYQEFVNKYSLSKTLRFELIPQGKTLENIKARGLILDDEKRAKDYKKAKQIIDKYHQFFIEE

ILSSVCISEDLLQNYSDVYFKLKKSDDDNLQKDFKSAKDTIKKQISEYIKDSEKFKNLFNQNLI

DAKKGQESDLILWLKQSKDNGIELFKANSDITDIDEALEIIKSFKGWTTYFKGFHENRKNVYSS

NDIPTSIIYRIVDDNLPKFLENKAKYESLKDKAPEATNYEQIKKDLAEELTFDIDYKTSEVNQR

VFSLDEVFEIANFNNYLNQSGITKFNTIIGGKFVNGENTKRKGINEYINLYSQQINDKTLKKYK

MSVLFKQILSDTESKSFVIDKLEDDSDVVTTMQSFYEQIAAFKTVEEKSIKETLSLLFDDLKAQ

KLDLSKIYFKNDKSLTDLSQQVFDDYSVIGTAVLEYITQQIAPKNLDNPSKKEQELIAKKTEKA

KYLSLETIKLALEEFNKHRDIDKQCRFEEILANFAAIPMIFDEIAQNKDNLAQISIKYQNQGKK

DLLQASAEDDVKAIKDLLDQTNNLLHKLKIFHISQSEDKANILDKDEHFYLVFEECYFELANIV

PLYNKIRNYITQKPYSDEKFKLNFENSTLANGWDKNKEPDNTAILFIKDDKYYLGVMNKKNNKI

FDDKAIKENKGEGYKKIVYKLLPGANKMLPKVFFSAKSIKFYNPSEDILRIRNHSTHTKNGSPQ

KGYEKFEFNIEDCRKFIDFYKQSISKHPEWKDFGFRFSDTQRYNSIDEFYREVENQGYKLTFEN

ISESYIDSVVNQGKLYLFQIYNKDFSAYSKGRPNLHTLYWKALFDERNLQDVVYKLNGEAELFY

RKQSIPKKITHPAKEAIANKNKDNPKKESVFEYDLIKDKRFTEDKFFFHCPITINFKSSGANKF

NDEINLLLKEKANDVHILSIARGERHLAYYTLVDGKGNIIKQDTFNIIGNDRMKTNYHDKLAAI

EKDRDSARKDWKKINNIKEMKEGYLSQVVHEIAKLVIEYNAIVVFADLNFGFKRGRFKVEKQVY

QKLEKMLIEKLNYLVFKDNEFDKTGGVLRAYQLTAPFETFKKMGKQTGIIYYVPAGFTSKICPV

TGFVNQLYPKYESVSKSQEFFSKFDKICYNLDKGYFEFSFDYKNFGDKAAKGKWTIASFGSRLI

NFRNSDKNHNWDTREVYPTKELEKLLKDYSIEYGHGECIKAAICGESDKKFFAKLTSVLNTILQ

MRNSKTGTELDYLISPVADVNGNFFDSRQAPKNMPQDAAANGAYHIGLKGLMLLGRIKNNQEGK

KLNLVIKNEEYFEFVQNRNN

In some embodiments, one of the Cas9 domains present in the fusion protein may be replaced with a guide nucleotide sequence-programmable DNA-binding protein domain that has no requirements for a PAM sequence.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT or a NNGRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

```
Exemplary SaCas9 sequence
KRNYILGLDIGITSVGYGIIDYETRDVIDAGVRLFKEANVENNEGRRSKRGARRLKRRRRHRIQ

RVKKLLFDYNLLTDHSELSGINPYEARVKGLSQKLSEEEFSAALLHLAKRRGVHNVNEVEEDTG

NELSTKEQISRNSKALEEKYVAELQLERLKKDGEVRGSINRFKTSDYVKEAKQLLKVQKAYHQL

DQSFIDTYIDLLETRRTYYEGPGEGSPFGWKDIKEWYEMLMGHCTYFPEELRSVKYAYNADLYN

ALNDLNNLVITRDENEKLEYYEKFQIIENVFKQKKKPTLKQIAKEILVNEEDIKGYRVTSTGKP

EFTNLKVYHDIKDITARKEIIENAELLDQIAKILTIYQSSEDIQEELTNLNSELTQEEIEQISN

LKGYTGTHNLSLKAINLILDELWHTNDNQIAIFNRLKLVPKKVDLSQQKEIPTTLVDDFILSPV

VKRSFIQSIKVINAIIKKYGLPNDIIIELAREKNSKDAQKMINEMQKRNRQTNERIEE11RTTG

KENAKYLIEKIKLHDMQEGKCLYSLEAIPLEDLLNNPFNYEVDHIIPRSVSFDNSFNNKVLVKQ

EE<u>N</u>SKKGNRTPFQYLSSSDSKISYETFKKHILNLAKGKGRISKTKKEYLLEERDINRFSVQKDF

INRNLVDTRYATRGLMNLLRSYFRVNNLDVKVKSINGGFTSFLRRKWKFKKERNKGYKHHAEDA

L11ANADFIFKEWKKLDKAKKVMENQMFEEKQAESMPEIETEQEYKEIFITPHQIKHIKDFKDY

KYSHRVDKKPNRELINDTLYSTRKDDKGNTLIVNNLNGLYDKDNDKLKKLINKSPEKLLMYHHD

PQTYQKLKLIMEQYGDEKNPLYKYYEETGNYLTKYSKKDNGPVIKKIKYYGNKLNAHLDITDDY

PNSRNKVVKLSLKPYRFDVYLDNGVYKFVTVKNLDVIKKENYYEVNSKCYEEAKKLKKISNQAE

FIASFYNNDLIKINGELYRVIGVNNDLLNRIEVNMIDITYREYLENMNDKRPPRIIKTIASKTQ

SIKKYSTDILGNLYEVKSKKHPQIIKKG
```

[45] Residue N579 above, which is underlined and in bold, may be mutated (e.g., to a A579) to yield a SaCas9 nickase.

```
Exemplary SaCas9n sequence
KRNYILGLDIGITSVGYGIIDYETRDVIDAGVRLFKEANVENNEGRRSKRGARRLKRRRRHRIQ

RVKKLLFDYNLLTDHSELSGINPYEARVKGLSQKLSEEEFSAALLHLAKRRGVHNVNEVEEDTG

NELSTKEQISRNSKALEEKYVAELQLERLKKDGEVRGSINRFKTSDYVKEAKQLLKVQKAYHQL

DQSFIDTYIDLLETRRTYYEGPGEGSPFGWKDIKEWYEMLMGHCTYFPEELRSVKYAYNADLYN

ALNDLNNLVITRDENEKLEYYEKFQIIENVFKQKKKPTLKQIAKEILVNEEDIKGYRVTSTGKP

EFTNLKVYHDIKDITARKEIIENAELLDQIAKILTIYQSSEDIQEELTNLNSELTQEEIEQISN

LKGYTGTHNLSLKAINLILDELWHTNDNQIAIFNRLKLVPKKVDLSQQKEIPTTLVDDFILSPV

VKRSFIQSIKVINAIIKKYGLPNDIIIELAREKNSKDAQKMINEMQKRNRQTNERIEEIIRTTG

KENAKYLIEKIKLHDMQEGKCLYSLEAIPLEDLLNNPFNYEVDHIIPRSVSFDNSFNNKVLVKQ

EE<u>A</u>SKKGNRTPFQYLSSSDSKISYETFKKHILNLAKGKGRISKTKKEYLLEERDINRFSVQKDF

INRNLVDTRYATRGLMNLLRSYFRVNNLDVKVKSINGGFTSFLRRKWKFKKERNKGYKHHAEDA
```

-continued

LCIANADFIEKEWKKLDKAKKVMENQMFEEKQAESMPEIETEQEYKEIFITPHQIKHIKDFKDY

KYSHRVDKKPNRELINDTLYSTRKDDKGNTLIVNNLNGLYDKDNDKLKKLINKSPEKLLMYHHD

PQTYQKLKLIMEQYGDEKNPLYKYYEETGNYLTKYSKKDNGPVIKKIKYYGNKLNAHLDITDDY

PNSRNKVVKISLKPYRFDVYLDNGVYKFVTVKNLDVIKKENYYEVNSKCYEEAKKLKKISNQAE

FIASFYNNDIIKINGELYRVIGVNNDLLNRIEVNMIDITYREYLENMNDKRPPRIIKTIASKTQ

SIKKYSTDILGNLYEVKSKKHPQIIKKG

Residue A579 above, which can be mutated from N579 to
yield a SaCas9 nickase, is underlined and in bold.

Exemplary SaKKH Cas9
KRNYILGLDIGITSVGYGIIDYETRDVIDAGVRLFKEANVENNEGRRSKRGARRLKRRRRHRIQ

RVKKLLFDYNLLTDHSELSGINPYEARVKGLSQKLSEEEFSAALLHLAKRRGVHNVNEVEEDTG

NELSTKEQISRNSKALEEKYVAELQLERLKKDGEVRGSINRFKTSDYVKEAKQLLKVQKAYHQL

DQSFIDTYIDLLETRRTYYEGPGEGSPFGWKDIKEWYEMLMGHCTYFPEELRSVKYAYNADLYN

ALNDLNNLVITRDENEKLEYYEKFQIIENVFKQKKKPTLKQIAKEILVNEEDIKGYRVTSTGKP

EFTNLKVYHDIKDITARKEIIENAELLDQIAKILTIYOSSEDIQEELTNLNSELTQEEIEQISN

LKGYTGTHNLSLKAINLILDELWHTNDNQIAIFNRLKLVPKKVDLSQQKEIPTTLVDDFILSPV

VKRSFIQSIKVINAIIKKYGLPNDIIIEDAREKNSKDAQKMINEMQKRNRQTNERIEEIIRTTG

KENAKYLIEKIKLHDMQEGKCLYSLEAIPLEDLLNNPFNYEVDHIIPRSVSFDNSFNNKVLVKQ

EEASKKGNRTPFQYLSSSDSKISYETFKKHILNLAKGKGRISKTKKEYLLEERDINRFSVQKDF

INRNLVDTRYATRGLMNLLRSYFRVNNLDVKVKSINGGFTSFLRRKWKFKKERNKGYKHHAEDA

LIIANADFIFKEWKKLDKAKKVMENQMFEEKQAESMPEIETEQEYKEIFITPHQIKHIKDFKDY

KYSHBVDKKPNRKLINDTLYSTRKDDKGNTLTVNNLNGLYDKDNDKLKKLTNKSPEKLLMYHHD

PQTYQKLKLIMEQYGDEKNPLYKYYEETGNYLTKYSKKDNGPVIKKIKYYGNKLNAHLDITDDY

PNSRNKVVKLSLKPYRFDVYLDNGVYKFVTVKNLDVIKKENYYEVNSKCYEEAKKLKKISNQAE

FIASFYKNDLIKTNGELYRVIGVNNDLLNRIEVNMIDITYREYLENMNDKRPPHIIKTIASKTQ

SIKKYSTDILGNLYEVKSKKHPQIIKKG.

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics.

In some embodiments, the napDNAbp is a circular permutant. In the following sequence, the plain text denotes an adenosine deaminase sequence, bold sequence indicates sequence derived from Cas9, the italicized sequence denotes a linker sequence, and the underlined sequence denotes a bipartite nuclear localization sequence, and double underlined sequence indicates mutations. The asterisk (*) denotes a STOP codon.

CP5 (with MSP "NGC = Pam Variant with mutations Regular Cas9 likes NGG"
PID = Protein Interacting Domain and "D10A" nickase):
EIGKATAKYFFYSNIMNFFKTEITLANGEIRKRPLIETNGETGEIVWDKGRDFATVRKVLSMPQ

VNIVKKTEVQTGGFSKESILPKRNSDKLIARKKDWDPKKYGGFMQPTVAYSVLVVAKVEKGKSK

KLKSVKELLGITIMERSSFEKNPIDFLEAKGYKEVKKDLIIKLPKYSLFELENGRKRMLASAKF

LQKGNELALPSKYVNFLYLASHYEKLKGSPEDNEQKQLFVEQHKHYLDEIIEQISEFSKRVILA

DANLDKVLSAYNKHRDKPIREQAENIIHLFTLTNLGAPRAFKYFDTTIARKEYRSTKEVLDATL

IHQSITGLYETRIDLSQLGGDG*GSGGSGGSGGSGGSGGSGG*MDKKYSIGLAIGTNSVGWAVITD

EYKVPSKKFKVLGNTDRHSIKKNLIGALLFDSGETAEATRLKRTARRRYTRRKNRICYLQEIFS

-continued

```
NEMAKVDDSFFHRLEESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPINASGVDAKAILSAR

LSKSRRLENLIAQLPGEKKNGLFGNLIALSLGLTPNFKSNFDLAEDAKLQLSKDTYDDDLDNLL

AQIGDQYADLFLAAKNLSDAILLSDILRVNTEITKAPLSASMIKRYDEHHQDLTLLKALVRQQL

PEKYKEIFFDQSKNGYAGYIDGGASQEEFYKFIKPILEKMDGTEELLVKLNREDLLRKQRTFDN

GSIPHQIHLGELHAILRRQEDFYPFLKDNREKIEKILTFRIPYYVGPLARGNSRFAWMTRKSEE

TITPWNFEEVVDKGASAQSFIERMTNFDKNLPNEKVLPKHSLLYEYFTVYNELTKVKYVTEGMR

KPAFLSGEQKKAIVDLLFKTNRKVTVKQLKEDYFKKIECFDSVEISGVEDRFNASLGTYHDLLK

IIKDKDFLDNEENEDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKRIEEGIKEL

GSQILKEHPVENTQLQNEKLYLYYLQNGRDMYVDQELDINRLSDYDVDHIVPQSFLKDDSIDNK

VLTRSDKNRGKSDNVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDFQFYKVREINNYHH

AHDAYLNAVVGTALIKKYPKLESEFVYGDYKVYDVRKMIAKSEQEGADKRTADGSEFESPKKKR

KV*
```

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (Cas12b/C2c1, and Cas12c/C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, Cas12b/C2c1, and Cas12c/C2c3, contain RuvC-like endonuclease domains related to Cpf1. A third system contains an effector with two predicated HEPN RNase domains. Production of mature CRISPR RNA is tracrRNA-independent, unlike production of CRISPR RNA by Cas12b/C2c1. Cas12b/C2c1 depends on both CRISPR RNA and tracrRNA for DNA cleavage.

The crystal structure of *Alicyclobaccillus acidoterrastris* Cas12b/C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2c1 protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2c1 or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2c1 or Cas12c/C2c3 from other bacterial species may also be used in accordance with the present disclosure.

A Cas12b/C2c1 ((uniprot.org/uniprot/T0D7A2#2) sp|T0D7A2|C2C1_ALIAG CRISPR-associated endonuclease C2c1 OS=*Alicyclobacillus acido-terrestris* (strain ATCC 49025/DSM 3922/CIP 106132/NCIMB 13137/GD3B) GN=c2c1 PE=1 SV=1) amino acid sequence is as follows:

```
MAVKSIKVKLRLDDMPEIRAGLWKLHKEVNAGVRYYTEWLSLLRQENLYRRSPNGDGEQECDKT

AEECKAELLERLRARQVENGHRGPAGSDDELLQLARQLYELLVPQAIGAKGDAQQIARKFLSPL
```

-continued

ADKDAVGGLGIAKAGNKPRWVRMREAGEPGWEEEKEKAETRKSADRTADVLRALADFGLKPLMR

VYTDSEMSSVEWKPLRKGQAVRTWDRDMFQQAIERMMSWESWNQRVGQEYAKLVEQKNRFEQKN

FVGQEHLVHLVNQLQQDMKEASPGLESKEQTAHYVTGRALRGSDKVFEKWGKLAPDAPFDLYDA

EIKNVQRRNTRRFGSHDLFAKLAEPEYQALWREDASFLTRYAVYNSILRKLNHAKMFATFTLPD

ATAHPIWTRFDKLGGNLHQYTFLFNEFGERRHAIRFHKLLKVENGAREVDDVTVPISMSEQLD

NLLPRDPNEPIALYFRDYGAEQHFTGEFGGAKIQCRRDQLAHMHRRRGARDVYLNVSVRVQSQS

EARGERRPPYAAVFRLVGDNHRAFVHFDKLSDYLAEHPDDGKLGSEGLLSGLRWISVDLGLRTS

ASISVFRVARKDELKPNSKGRVPFFFPIKGNDNLVAVHERSQLLKLPGETESKDLRAIREERQR

TLRQLRTQLAYLRLLVRCGSEDVGRRERSWAKLIEQPVDAANHMTPDWREAFENELQKLKSLHG

ICSDKEWMDAVYESVRRVWRHMGKQVRDWRKDVRSGERPKIRGYAKDVVGGNSIEQIEYLERQY

KFLKSWSFFGKVSGQVIRAEKGSRFAITLREHIDHAKEDRLKKLADRIIMEALGYVYALDERGK

GKWVAKYPPCQLILLEELSEYQFNNDRPPSENNQLMQWSHRGVFQELINQAQVHDLLVGTMYAA

FSSRFDARTGAPGIRCRRVPARCTQEHNPEPFPWWLNKFVVEHTLDACPLRADDLIPTGEGEIF

VSPFSAEEGDFHQIHADLNAAQNLQQRLWSDFDISQIRLRCDWGEVDGELVLIPRLTGKRTADS

YSNKVFYTNTGVTYYERERGKKRRKVFAQEKLSEEEAELLVEADEAREKSVVLMRDPSGIINRG

NWTRQKEFWSMVNQRIEGYLVKQIRSRVPLQDSACENTGDI

AacCas12b (*Alicyclobacillus acidiphilus*)-WP_067623834
MAVKSMKVKLRLDNMPEIRAGLWKLHTEVNAGVRYYTEWLSLLRQENLYRRSPNGDGEQECYKT

AEECKAELLERLRARQVENGHCGPAGSDDELLQLARQLYELLVPQAIGAKGDAQQIARKFLSPL

ADKDAVGGLGIAKAGNKPRWVRMREAGEPGWEEEKAKAEARKSTDRTADVLRALADFGLKPLMR

VYTDSDMSSVQWKPLRKGQAVRTWDRDMFQQAIERMMSWESWNQRVGEAYAKLVEQKSRFEQKN

FVGQEHLVQLVNQLQQDMKEASHGLESKEQTAHYLTGRALRGSDKVFEKWEKLDPDAPFDLYDT

EIKNVQRRNTRRFGSHDLFAKLAEPKYQALWREDASFLTRYAVYNSIVRKLNHAKMFATFTLPD

ATAHPIWTRFDKLGGNLHQYTFLFNEFGEGRHAIRFQKLLTVEDGVAKEVDDVTVPISMSAQLD

DLLPRDPHELVALYFQDYGAEQHLAGEFGGAKIQYRRDQLNHLHARRGARDVYLNLSVRVQSQS

EARGERRPPYAAVFRLVGDNHRAFVHFDKLSDYLAEHPDDGKLGSEGLLSGLRVMSVDLGLRTS

ASISVFRVARKDELKPNSEGRVPFCFPIEGNENLVAVHERSQLLKLPGETESKDLRAIREERQR

TLRQLRTQLAYLRLLVRCGSEDVGRRERSWAKLIEQPMDANQMTPDWREAFEDELQKLKSLYGI

CGDREWTEAVYESVRRVWRHMGKQVRDWRKDVRSGERPKIRGYQKDVVGGNSIEQIEYLERQYK

FLKSWSFFGKVSGQVIRAEKGSRFAITLREHIDHAKEDRLKKLADRIIMEALGYVYALDDERGK

GKWVAKYPPCQLILLEELSEYQFNNDRPPSENNQLMQWSHRGVFQELLNQAQVHDLLVGTMYAA

FSSRFDARTGAPGIRCRRVPARCAREQNPEPFPWWLNKFVAEHKLDGCPLRADDLIPTGEGEFF

VSPFSAEEGDFHQIHADLNAAQNLQRRLWSDFDISQIRLRCDWGEVDGEPVLIPRTTGKRTADS

YGNKVFYTKTGVTYYERERGKKRRKVFAQEELSEEEAELLVEADEAREKSVVLMRDPSGIINRG

DWTRQKEFWSMVNQRIEGYLVKQIRSRVRLQESACENTGDI

BhCas12b (*Bacillus hisashii*) NCBI Reference Sequence: WP_095142515
MAPKKKRKVGIHGVPAAATRSFTLKIEPNEEVKKGLWKTHEVLNHGIAYYMNILKLIRQEAIYE

HHEQDPKNPKKVSKAEIQAELWDFVLKMQKCNSFTHEVDKDEVFNILRELYEELVPSSVEKKGE

ANQLSNKFLYPLVDPNSQSGKGTASSGRKPRWYNLKIAGDPSWEEEKKKWEEDKKKDPLAKILG

KLAEYGLIPLFIPYTDSNEPIVKEIKWMEKSRNQSVRRLDKDMFIQALERFLSWESWNLKVKEE

YEKVEKEYKTLEERIKEDIQALKALEQYEKERQEQLLRDTLNTNEYRLSKRGLRGWRE11QKWL

-continued

```
KMDENEPSEKYLEVFKDYQRKHPREAGDYSVYEFLSKKENHFIWRNHPEYPYLYATFCEIDKKK

KDAKQQATFTLADPINHPLWVRFEERSGSNLNKYRILTEQLHTEKLKKKLTVQLDRLIYPTESG

GWEEKGKVDIVLLPSRQFYNQIFLDIEEKGKHAFTYKDESIKFPLKGTLGGARVQFDRDHLRRY

PHKVESGNVGRIYFNMTVNIEPTESPVSKSLKIHRDDFPKVVNFKPKELTEWIKDSKGKKLKSG

IESLEIGLRVMSIDLGQRQAAAASIFEVVDQKPDIEGKLFFPIKGTELYAVHRASFNIKLPGET

LVKSREVLRKAREDNLKLMNQKLNFLRNVLHFQQFEDITEREKRVTKWISRQENSDVPLVYQDE

LIQIRELMYKPYKDWVAFLKQLHKRLEVEIGKEVKHWRKSLSDGRKGLYGISLKNIDEIDRTRK

FLLRWSLRPTEPGEVRRLEPGQRFAIDQLNHLNALKEDRLKKMANTIIMHALGYCYDVRKKKWQ

AKNPACQIILFEDLSNYNPYEERSRFENSKLMKWSRREIPRQVALQGEIYGLQVGEVGAQFSSR

FHAKTGSPGIRCSVVTKEKLQDNRFFKNLQREGRLTLDKIAVLKEGDLYPDKGGEKFISLSKDR

KCVTTHADINAAQNLQKRFWTRTHGFYKVYCKAYQVDGQTVYIPESKDQKQKIIEEFGEGYFIL

KDGVYEWVNAGKLKIKKGSSKQSSSELVDSDILKDSFDLASELKGEKLMLYRDPSGNVFPSDKW

MAAGVFFGKLERILISKLTNQYSISTIEDDSSKQSMKRPAATKKAGQAKKKK
```

In some embodiments, the Cas12b is BvCas12b (V4), which is a variant of BhCas12b and comprises the following changes relative to BhCas12b: S893R, K846R, and E837G. BhCas12b (V4) is expressed as follows: 5' mRNA Cap-5'UTR-bhCas12b-STOP sequence-3'UTR-120polyA tail.

```
5'UTR:
GGGAAATAAGAGAGAAAAGAAGAGTAAGAAGAAATATAAGAGCCACC

3' UTR (TriLink standard UTR)
GCTGGAGCCTCGGTGGCCATGCTTCTTGCCCCTTGGGCCTCCCCCCAGCCCCTCCTCCCCTTCC

TGCACCCGTACCCCCGTGGTCTTTGAATAAAGTCTGA

Nucleic acid sequence of bhCas12b (V4)
ATGGCCCCAAAGAAGAAGCGGAAGGTCGGTATCCACGGAGTCCCAGCAGCCGCCACCAGATCCT

TCATCCTGAAGATCGAGCCCAACGAGGAAGTGAAGAAAGGCCTCTGGAAAACCCACGAGGTGCT

GAACCACGGAATCGCCTACTACATGAATATCCTGAAGCTGATCCGGCAAGAGGCCATCTACGAG

CACCACGAGCAGGACCCCAAGAATCCCAAGAAGGTGTCCAAGGCCGAGATCCAGGCCGAGCTGT

GGGATTTCGTGCTGAAGATGCAGAAGTGCAACAGCTTCACACACGAGGTGGACAAGGACGAGGT

GTTCAACATCCTGAGAGAGCTGTACGAGGAACTGGTGCCCAGCAGCGTGGAAAAGAAGGGCGAA

GCCAACCAGCTGAGCAACAAGTTTCTGTACCCTCTGGTGGACCCCAACAGCCAGTCTGGAAAGG

GAACAGCCAGCAGCGGCAGAAAGCCCAGATGGTACAACCTGAAGATTGCCGGCGATCCCTCCTG

GGAAGAAGAGAAGAAGAAGTGGGAAGAAGATAAGAAAAAGGACCCGCTGGCCAAGATCCTGGGC

AAGCTGGCTGAGTACGGACTGATCCCTCTGTTCATCCCCTACACCGACAGCAACGAGCCCATCG

TGAAAGAAATCAAGTGGATGGAAAAGTCCCGGAACCAGAGCGTGCGGCGGCTGGATAAGGACAT

GTTCATTCAGGCCCTGGAACGGTTCCTGAGCTGGGAGAGCTGGAACCTGAAAGTGAAAGAGGAA

TACGAGAAGGTCGAGAAAGAGTACAAGACCCTGGAAGAGAGGATCAAAGAGGACATCCAGGCTC

TGAAGGCTCTGGAACAGTATGAGAAAGAGCGGCAAGAACAGCTGCTGCGGGACACCCTGAACAC

CAACGAGTACCGGCTGAGCAAGAGAGGCCTTAGAGGCTGGCGGGAAATCATCCAGAAATGGCTG

AAAATGGACGAGAACGAGCCCTCCGAGAAGTACCTGGAAGTGTTCAAGGACTACCAGCGGAAGC

ACCCTAGAGAGGCCGGCGATTACAGCGTGTACGAGTTCCTGTCCAAGAAAGAGAACCACTTCAT

CTGGCGGAATCACCCTGAGTACCCCTACCTGTACGCCACCTTCTGCGAGATCGACAAGAAAAAG

AAGGACGCCAAGCAGCAGGCCACCTTCACACTGGCCGATCCTATCAATCACCCTCTGTGGGTCC
```

-continued

GATTCGAGGAAAGAAGCGGCAGCAACCTGAACAAGTACAGAATCCTGACCGAGCAGCTGCACAC

CGAGAAGCTGAAGAAAAAGCTGACAGTGCAGCTGGACCGGCTGATCTACCCTACAGAATCTGGC

GGCTGGGAAGAGAAGGGCAAAGTGGACATTGTGCTGCTGCCCAGCCGGCAGTTCTACAACCAGA

TCTTCCTGGACATCGAGGAAAAGGGCAAGCACGCCTTCACCTACAAGGATGAGAGCATCAAGTT

CCCTCTGAAGGGCACACTCGGCGGAGCCAGAGTGCAGTTCGACAGAGATCACCTGAGAAGATAC

CCTCACAAGGTGGAAAGCGGCAACGTGGGCAGAATCTACTTCAACATGACCGTGAACATCGAGC

CTACAGAGTCCCCAGTGTCCAAGTCTCTGAAGATCCACCGGGACGACTTCCCCAAGGTGGTCAA

CTTCAAGCCCAAAGAACTGACCGAGTGGATCAAGGACAGCAAGGGCAAGAAACTGAAGTCCGGC

ATCGAGTCCCTGGAAATCGGCCTGAGAGTGATGAGCATCGACCTGGGACAGAGACAGGCCGCTG

CCGCCTCTATTTTCGAGGTGGTGGATCAGAAGCCCGACATCGAAGGCAAGCTGTTTTTCCCAAT

CAAGGGCACCGAGCTGTATGCCGTGCACAGAGCCAGCTTCAACATCAAGCTGCCCGGCGAGACA

CTGGTCAAGAGCAGAGAAGTGCTGCGGAAGGCCAGAGAGGACAATCTGAAACTGATGAACCAGA

AGCTCAACTTCCTGCGGAACGTGCTGCACTTCCAGCAGTTCGAGGACATCACCGAGAGAGAGAA

GCGGGTCACCAAGTGGATCAGCAGACAAGAGAACAGCGACGTGCCCCTGGTGTACCAGGATGAG

CTGATCCAGATCCGCGAGCTGATGTACAAGCCTTACAAGGACTGGGTCGCCTTCCTGAAGCAGC

TCCACAAGAGACTGGAAGTCGAGATCGGCAAAGAAGTGAAGCACTGGCGGAAGTCCCTGAGCGA

CGGAAGAAAGGGCCTGTACGGCATCTCCCTGAAGAACATCGACGAGATCGATCGGACCCGGAAG

TTCCTGCTGAGATGGTCCCTGAGGCCTACCGAACCTGGCGAAGTGCGTAGACTGGAACCCGGCC

AGAGATTCGCCATCGACCAGCTGAATCACCTGAACGCCCTGAAAGAAGATCGGCTGAAGAAGAT

GGCCAACACCATCATCATGCACGCCCTGGGCTACTGCTACGACGTGCGGAAGAAGAAATGGCAG

GCTAAGAACCCCGCCTGCCAGATCATCCTGTTCGAGGATCTGAGCAACTACAACCCCTACGAGG

AAAGGTCCCGCTTCGAGAACAGCAAGCTCATGAAGTGGTCCAGACGCGAGATCCCCAGACAGGT

TGCACTGCAGGGCGAGATCTATGGCCTGCAAGTGGGAGAAGTGGGCGCTCAGTTCAGCAGCAGA

TTCCACGCCAAGACAGGCAGCCCTGGCATCAGATGTAGCGTCGTGACCAAAGAGAAGCTGCAGG

ACAATCGGTTCTTCAAGAATCTGCAGAGAGAGGGCAGACTGACCCTGGACAAAATCGCCGTGCT

GAAAGAGGGCGATCTGTACCCAGACAAAGGCGGCGAGAAGTTCATCAGCCTGAGCAAGGATCGG

AAGTGCGTGACCACACACGCCGACATCAACGCCGCTCAGAACCTGCAGAAGCGGTTCTGGACAA

GAACCCACGGCTTCTACAAGGTGTACTGCAAGGCCTACCAGGTGGACGGCCAGACCGTGTACAT

CCCTGAGAGCAAGGACCAGAAGCAGAGAGATCATCGAAGAGTTCGGCGAGGGCTACTTCATTCTG

AAGGACGGGGTGTACGAATGGGTCAACGCCGGCAAGCTGAAAATCAAGAAGGGCAGCTCCAAGC

AGAGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAATGG

ATGGCCGCTGGCGTGTTCTTCGGAAAGCTGGAACGCATCCTGATCAGCAAGCTGACCAACCAGT

ACTCCATCAGCACCATCGAGGACGACAGCAGCAAGCAGTCTATGAAAAGGCCGGCGGCCACGAA

AAAGGCCGGCCAGGCAAAAAAGAAAAAG

In some embodiments, the Cas12b is BvCas12B. In some embodiments, the Cas12b comprises amino acid substitutions S893R, K846R, and E837G as numbered in the BvCas12b exemplary sequence provided below.

ByCas12b (*Bacillus* sp. V3-13) NCBI Reference Sequence: WP_101661451.1
MAIRSIKLKMKTNSGTDSIYLRKALWRTHQLINEGIAYYMNLLTLYRQEAIGDKTKEAYQAELI

NIIRNQQRNNGSSEEHGSDQEILALLRQLYELIIPSSIGESGDANQLGNKFLYPLVDPNSQSGK

-continued

GTSNAGRKPRWKRLKEEGNPDWELEKKKDEERKAKDPTVKIFDNLNKYGLLPLFPLFTNIQKDI

EWLPLGKRQSVRKWDKDMFIQAIERLLSWESWNRRVADEYKQLKEKTESYYKEHLTGGEEWIEK

IRKFEKERNMELEKNAFAPNDGYFITSRQIRGWDRVYEKWSKLPESASPEELWKVVAEQQNKMS

EGFGDPKVFSFLANRENRDIWRGHSERIYHIAAYNGLQKKLSRTKEQATFTLPDAIEHPLWIRY

ESPGGTNLNLFKLEEKQKKNYYVTLSKIIWPSEEKWIEKENIEIPLAPSIQFNRQIKLKQHVKG

KQEISFSDYSSRISLDGVLGGSRIQFNRKYIKNHKELLGEGDIGPVFFNLVVDVAPLQETRNGR

LQSPIGKALKVISSDFSKVIDYKPKELMDWMNTGSASNSFGVASLLEGMRVMSIDMGQRTSASV

SIFEVVKELPKDQEQKLFYSINDTELFAIHKRSFLLNLPGEVVTKNNKQQRQERRKKRQFVRSQ

TRMLANVLRLETKKTPDERKKAIHKLMEIVQSYDSWTASQKEVWEKELNLLTNMAAFNDEIWKE

SLVELHHRIEPYVGQIVSKWRKGLSEGRKNLAGISMWNIDELEDTRRLLISWSKRSRTPGEANR

IETDEPFGSSLLQHIQNVKDDRLKQMANLIIMTALGFKYDKEEKDRYKRWKETYPACQIILFEN

LNRYLFNLDRSRRENSRLMKWAHRSIPRTVSMQGEMFGLQVGDVRSEYSSRFHAKTGAPGIRCH

ALTEEDLKAGSNTLKRLIEDGFINESELAYLKKGDIIPSQGGELFVTLSKRYKKDSDNNELTVI

HADINAAQNLQKRFWQQNSEVYRVPCQLARMGEDKLYIPKSQTETIKKYFGKGSFVKNNTEQEV

YKWEKSEKMKIKTDTTFDLQDLDGFEDISKTIELAQEQQKKYLTMFRDPSGYFFNNETWRPQKE

YWSIVNNIIKSCLKKKILSNKVEL

In some embodiments, the Cas12b is BTCas12b.BTCas12b (*Bacillus thermoamylovorans*) NCB1 Reference Sequence: WP_041902512
MATRSFILKIEPNEEVKKGLWKTHEVLNHGIAYYMNILKLIRQEAIYEHHEQDPKNPKKV

SKAEIQAELWDFVLKMQKCNSFTHEVDKDVVFNILRELYEELVPSSVEKKGEANQLSNKE

LYPLVDPNSQSGKGTASSGRKPRWYNLKIAGDPSWEEEKKKWEEDKKKDPLAKILGKLAE

YGLIPLFIPFTDSNEPIVKEIKWMEKSRNQSVRRLDKDMFIQALERFLSWESWNLKVKEE

YEKVEKEHKTLEERIKEDIQAFKSLEQYEKERQEQLLRDTLNTNEYRLSKRGLRGWREII

QKWLKMDENEPSEKYLEVFKDYQRKHPREAGDYSVYEFLSKKENHFIWRNHPEYPYLYAT

FCEIDKKKKDAKQQATFTLADPINHPLWVRFEERSGSNLNKYRILTEQLHTEKLKKKLTV

QLDRLIYPTESGGWEEKGKVDIVLLPSRQFYNQIFLDIEEKGKHAFTYKDESIKFPLKGT

LGGARVQFDRDHLRRYPHKVESGNVGRIYFNMTVNIEPTESPVSKSLKIHRDDFPKFVNE

KPKELTEWIKDSKGKKLKSGIESLEIGLRVMSIDLGQRQAAAASIFEVVDQKPDIEGKLE

FPIKGTELYAVHRASFNIKLPGETLVKSREVLRKAREDNLKLMNQKLNFLRNVLHFQQFE

DITEREKRVTKWISRQENSDVPLVYQDELIQIRELMYKPYKDWVAFLKQLHKRLEVEIGK

EVKHWRKSLSDGRKGLYGISLKNIDEIDRTRKFLLRWSLRPTEPGEVRRLEPGQRFAIDQ

LNHLNALKEDRLKKMANTIIMHALGYCYDVRKKKWQAKNPACQIILFEDLSNYNPYEERS

RFENSKLMKWSRREIPRQVALQGEIYGLQVGEVGAQFSSRFHAKTGSPGIRCSVVTKEKL

QDNRFFKNLQREGRLTLDKIAVLKEGDLYPDKGGEKFISLSKDRKLVTTHADINAAQNLQ

KRFWTRTHGFYKVYCKAYQVDGQTVYIPESKDQKQKIIEEFGEGYFILKDGVYEWGNAGK

LKLKKGSSKQSSSELVDSDLLKDSEDLASELKGEKLMLYRDPSGNVEPSDKWMAAGVHHG

KLERILISKLTNQYSISTIEDDSSKQSM

60

In some embodiments, a napDNAbp refers to Cas12c. In some embodiments, the Cas12c protein is a Cas12c1 or a variant of Cas12c1. In some embodiments, the Cas12 protein is a Cas12c2 or a variant of Cas12c2. In some embodiments, the Cas12c protein is a Cas12c protein from *Oleiphilus* sp. HI0009 (i.e., OspCas12c) or a variant of OspCas12c. These Cas12c molecules have been described in Yan et al., "Functionally Diverse Type V CRISPR-Cas Systems," Science, 2019 Jan. 4; 363: 88-91; the entire contents of which is hereby incorporated by reference. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12c1, Cas12c2, or OspCas12c protein. In some embodiments, the napDNAbp is a naturally-occurring Cas12c1, Cas12c2, or OspCas12c protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any Cas12c1, Cas12c2, or OspCas12c protein described herein. It should be appreciated that Cas12c1, Cas12c2, or OspCas12c from other bacterial species may also be used in accordance with the present disclosure.

Cas12c1
MQTKKTHLHLISAKASRKYRRTIACLSDTAKKDLERRKQSGAADPAQELSCLKTIKFKLEVPEG

SKLPSFDRISQIYNALETIEKGSLSYLLFALILSGFRIFPNSSAAKTFASSSCYKNDQFASQIK

EIFGEMVKNFIPSELESILKKGRRKNNKDWTEENIKRVLNSEFGRKNSEGSSALFDSFLSKFSQ

ELFRKFDSWNEVNKKYLEAAELLDSMLASYGPFDSVCKMIGDSDSRNSLPDKSTIAFTNNAEIT

VDIESSVMPYMAIAALLREYRQSKSKAAPVAYVQSHLTTTNGNGLSWFFKFGLDLIRKAPVSSK

QSTSDGSKSLQELFSVPDDKLDGLKFIKEACEALPEASLLCGEKGELLGYQDFRTSFAGHIDSW

VANYVNRLFELIELVNQLPESIKLPSILTQKNHNLVASLGLQEAEVSHSLELFEGLVKNVRQTL

KKLAGIDISSSPNEQDIKEFYAFSDVLNRLGSIRNQIENAVQTAKKDKIDLESAIEWKEWKKLK

KLPKLNGLGGGVPKQQELLDKALESVKQIRHYQRIDFERVIQWAVNEHCLETVPKFLVDAEKKK

INKESSTDFAAKENAVRFLLEGIGAAARGKTDSVSKAAYNWFVVNNFLAKKDLNRYFINCQGCI

YKPPYSKRRSLAFALRSDNKDTIEVVWEKFETFYKEISKEIEKFNIFSQEFQTFLHLENLRMKL

LLRRIQKPIPAEIAFFSLPQEYYDSLPPNVAFLALNQEITPSEYITQFNLYSSFLNGNLILLRR

SRSYLRAKFSWVGNSKLIYAAKEARLWKIPNAYWKSDEWKMILDSNVLVFDKAGNVLPAPTLKK

VCEREGDLRLFYPLLRQLPHDWCYRNPFVKSVGREKNVIEVNKEGEPKVASALPGSLFRLIGPA

PFKSLLDDCFFNPLDKDLRECMLIVDQEISQKVEAQKVEASLESCTYSIAVPIRYHLEEPKVSN

QFENVLAIDQGEAGLAYAVFSLKSIGEAETKPIAVGTIRIPSIRRLIHSVSTYRKKKQRLQNFK

QNYDSTAFIMRENVTGDVCAKIVGLMKEFNAFPVLEYDVKNLESGSRQLSAVYKAVNSHFLYFK

EPGRDALRKQLWYGGDSWTIDGIEIVTRERKEDGKEGVEKIVPLKVFPGRSVSARFTSKTCSCC

GRNVFDWLFTEKKAKTNKKFNVNSKGELTTADGVIQLFEADRSKGPKFYARRKERTPLTKPIAK

GSYSLEEIERRVRTNLRRAPKSKQSRDTSQSQYFCVYKDCALHFSGMQADENAAINIGRRFLTA

LRKNRRSDFPSNVKISDRLLDN

Cas12c2
MTKHSIPLHAFRNSGADARKWKGRIALLAKRGKETMRTLQFPLEMSEPEAAAINTTPFAVAYNA

IEGTGKGTLFDYWAKLHLAGFRFFPSGGAATIFRQQAVFEDASWNAAFCQQSGKDWPWLVPSKL

YERFTKAPREVAKKDGSKKSIEFTQENVANESHVSLVGASITDKTPEDQKEFFLKMAGALAEKE

DSWKSANEDRIVAMKVIDEFLKSEGLHLPSLENIAVKCSVETKPDNATVAWHDAPMSGVQNLAI

GVFATCASRIDNIYDLNGGKLSKLIQESATTPNVTALSWLFGKGLEYFRTTDIDTIMQDFNIPA

SAKESIKPLVESAQAIPTMTVLGKKNYAPFRPNFGGKIDSWIANYASRLMLLNDILEQIEPGFE

LPQALLDNETLMSGIDMTGDELKELIEAVYAWVDAAKQGLATLLGRGGNVDDAVQTFEQFSAMM

DTLNGTLNTISARYVRAVEMAGKDEARLEKLIECKFDIPKWCKSVPKLVGISGGLPKVEEEIKV

MNAAFKDVRARMFVRFEEIAAYVASKGAGMDVYDALEKRELEQIKKLKSAVPERAHIQAYRAVL

HRIGRAVQNCSEKTKQLFSSKVIEMGVFKNPSHLNNFIFNQKGAIYRSPFDRSRHAPYQLHADK

LLKNDWLELLAEISATLMASESTEQMEDALRLERTRLQLQLSGLPDWEYPASLAKPDIEVEIQT

ALKMQLAKDTVTSDVLQRAFNLYSSVLSGLTFKLLRRSFSLKMRFSVADTTQLIYVPKVCDWAI

PKQYLQAEGEIGIAARVVTESSPAKMVTEVEMKEPKALGHFMQQAPHDWYFDASLGGTQVAGRI

VEKGKEVGKERKLVGYRMRGNSAYKTVLDKSLVGNTELSQCSMIIEIPYTQTVDADFRAQVQAG

LPKVSINLPVKETITASNKDEQMLFDRFVAIDLGERGLGYAVFDAKTLELQESGHRPIKAITNL

-continued

```
LNRTHHYEQRPNQRQKFQAKFNVNLSELRENTVGDVCHQINRICAYYNAFPVLEYMVPDRLDKQ

LKSVYESVTNRYIWSSTDAHKSARVQFWLGGETWEHPYLKSAKDKKPLVLSPGRGASGKGTSQT

CSCCGRNPFDLIKDMKPRAKIAVVDGKAKLENSELKLFERNLESKDDMLARRHRNERAGMEQPL

TPGNYTVDEIKALLRANLRRAPKNRRTKDTTVSEYHCVFSDCGKTMHADENAAVNIGGKFIADI

EK

OspCas12c
MTKLRHRQKKLTHDWAGSKKREVLGSNGKLQNPLLMPVKKGQVTEFRKAFSAYARATKGEMTDG

RKNMFTHSFEPFKTKPSLHQCELADKAYQSLHSYLPGSLAHFLLSAHALGFRIFSKSGEATAFQ

ASSKIEAYESKLASELACVDLSIQNLTISTLFNALTTSVRGKGEETSADPLIARFYTLLTGKPL

SRDTQGPERDLAEVISRKIASSFGTWKEMTANPLQSLQFFEEELHALDANVSLSPAFDVLIKMN

DLQGDLKNRTIVFDPDAPVFEYNAEDPADIIIKLTARYAKEAVIKNQNVGNYVKNAITTTNANG

LGWLLNKGLSLLPVSTDDELLEFIGVERSHPSCHALIELIAQLEAPELFEKNVFSDTRSEVQGM

IDSAVSNHIARLSSSRNSLSMDSEELERLIKSFQIHTPHCSLFIGAQSLSQQLESLPEALQSGV

NSADILLGSTQYMLTNSLVEESIATYQRTLNR1NYLSGVAGQINGAIKRKA1DGEKIHLPAAWS

ELISLPFIGQPVIDVESDLAHLKNQYQTLSNEFDTLISALQKNFDLNFNKALLNRTQHFEAMCR

STKKNALSKPEIVSYRDLLARLTSCLYRGSLVLRRAGIEVLKKHKIFESNSELREHVHERKHFV

FVSPLDRKAKKLLRLTDSRPDLLHVIDEILQHDNLENKDRESLWLVRSGYLLAGLPDQLSSSFI

NLPIITQKGDRRLIDLIQYDQINRDAFVMLVTSAFKSNLSGLQYRANKQSFVVTRTLSPYLGSK

LVYVPKDKDWLVPSQMFEGRFADILQSDYMVWKDAGRLCVIDTAKHLSNIKKSVFSSEEVLAFL

RELPHRTFIQTEVRGLGVNVDGIAFNNGDIPSLKTFSNCVQVKVSRTNTSLVQTLNRWFEGGKV

SPPSIQFERAYYKKDDQIHEDAAKRKIRFQMPATELVHASDDAGWTPSYLLGIDPGEYGMGLSL

VSINNGEVLDSGFIHINSLINFASKKSNHQTKVVPRQQYKSPYANYLEQSKDSAAGDIAHILDR

LIYKLNALPVFEALSGNSQSAADQVWTKVLSFYTWGDNDAQNSIRKQHWFGASHWDIKGMLRQP

PTEKKPKPYLAFPGSQVSSYGNSQRCSCCGKNPLEQLREMAKDISIKELKIRNSEIQLFDGTIK

LFNPDPSTVIERRRHNLGPSRIPVADRTFKNISPSSLEFKELITTVSRSIRHSPEFIAKKRGIG

SEYFCAYSDCNSSLNSEANAAANVAQKFQKQLFFEL
```

In some embodiments, a napDNAbp refers to Cas12g, Cas12h, or Cas12i, which have been described in, for example, Yan et al., "Functionally Diverse Type V CRISPR-Cas Systems," Science, 2019 Jan. 4; 363: 88-91; the entire contents of each is hereby incorporated by reference. By aggregating more than 10 terabytes of sequence data, new classifications of Type V Cas proteins were identified that showed weak similarity to previously characterized Class V protein, including Cas12g, Cas12h, and Cas12i. In some embodiments, the Cas12 protein is a Cas12g or a variant of Cas12g. In some embodiments, the Cas12 protein is a Cas12h or a variant of Cas12h. In some embodiments, the Cas12 protein is a Cas12i or a variant of Cas12i. It should be appreciated that other RNA-guided DNA binding proteins may be used as a napDNAbp, and are within the scope of this disclosure. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12g, Cas12h, or Cas12i protein. In some embodiments, the napDNAbp is a naturally-occurring Cas12g, Cas12h, or Cas12i protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any Cas12g, Cas12h, or Cas12i protein described herein. It should be appreciated that Cas12g, Cas12h, or Cas12i from other bacterial species may also be used in accordance with the present disclosure. In some embodiments, the Cas12i is a Cas12i11 or a Cas12i2.

```
Cas12g1
MAQASSTPAVSPRPRPRYREERTLVRKLLPRPGQSKQEFRENVKKLRKAFLQFNADVSGVCQWA

IQFRPRYGKPAEPTETFWKFFLEPETSLPPNDSRSPEFRRLQAFEAAAGINGAAALDDPAFTNE

LRDSILAVASRPKTKEAQRLFSRLKDYQPAHRMILAKVAAEWIESRYRRAHQNWERNYEEWKKE
```

-continued

KQEWEQNHPELTPEIREAFNQIFQQLEVKEKRVRICPAARLLQNKDNCQYAGKNKHSVLCNQFN

EFKKNHLQGKAIKFFYKDAEKYLRCGLQSLKPNVQGPFREDWNKYLRYMNLKEETLRGKNGGRL

PHCKNLGQECEFNPHTALCKQYQQQLSSRPDLVQHDELYRKWRREYWREPRKPVFRYPSVKRHS

IAKIFGENYFQADFKNSVVGLRLDSMPAGQYLEFAFAPWPRNYRPQPGETEISSVHLHFVGTRP

RIGFRFRVPHKRSRFDCTQEELDELRSRTFPRKAQDQKFLEAARKRLLETFPGNAEQELRLLAV

DLGTDSARAAFFIGKTFQQAFPLKIVKIEKLYEQWPNQKQAGDRRDASSKQPRPGLSRDHVGRH

LQKMRAQASEIAQKRQELTGTPAPETTTDQAAKKATLQPFDLRGLTVHTARMIRDWARLNARQI

IQLAEENQVDLIVLESLRGFRPPGYENLDQEKKRRVAFFAHGRIRRKVTEKAVERGMRVVTVPY

LASSKVCAECRKKQKDNKQWEKNKKRGLFKCEGCGSQAQVDENAARVLGRVFWGEIELPTAIP

Cas12h1

MKVHRTPRSQLLKTKQYEGSFVEWYRDLQEDRKKFASLLFRWAAFGYAAREDDGATYTSPSQAT

LERRLLLGDAEDVAIKFLDVLFKGGAPSSSCYSLFYEDFALRDKAKYSGAKREFIEGLATMPLD

KIIERIRQDEQLSKIPAEEWLILGAEYSPEEIWEQVAPRIVNVDRSLGKQLRERLGIKCRRPHD

AGYCKILMEVVARQLRSHNETYHEYLNQTHEMKTKVANNLTNEFDLVCEFAEVLEEKNYGLGWY

VLWQGVKQALKEQKKPTKIQIAVDQLRQPKFAGLLTAKWRALKGAYDTWKLKKRLEKRKAFPYM

PNWDNDYQIPVGLTGLGVFTLEVKRTEVVVDLKEHGKLFCSHSHYFGDLTAEKHPSRYHLKFRH

KLKLRKRDSRVEPTIGPWIEAALREITIQKKPNGVFYLGLPYALSHGIDNFQIAKRFFSAAKPD

KEVINGLPSEMVVGAADLNLSNIVAPVKARIGKGLEGPLHALDYGYGELIDGPKILTPDGPRCG

ELISLKRDIVEIKSAIKEFKACQREGLTMSEETTTWLSEVESPSDSPRCMIQSRIADTSRRLNS

FKYQMNKEGYQDLAEALRLLDAMDSYNSLLESYQKMHLSPGEQSPKEAKHDTKKASFKDLLRRR

VAHTIVEYFDDCDIVFFEDLDGPSDSDSRNNALVKLLSPRTLLLYIRQALEKRGIGMVEVAKDG

TSQNNPISGHVGWRNKQNKSEIYFYEDKELLVMDADEVGAMNILCRGLNHSVCPYSFVTKAPEK

KNDEKKEGDYGKRVKRFLKDRYGSSNVRFLVASMGFVTVTTKRPKDALVGKRLYYHGGELVTHD

LHNRMKDEIKYLVEKEVLARRVSLSDSTIKSYKSFAHV

Cas12i1

MSNKEKNASETRKAYTTKMIPRSHDRMKLLGNFMDYLMDGTPIFFELWNQFGGGIDRDIISGTA

NKDKISDDLLLAVNWFKVMPINSKPQGVSPSNLANLFQQYSGSEPDIQAQEYFASNFDTEKHQW

KDMRVEYERLLAELQLSRSDMHHDLKLMYKEKCIGLSLSTAHYITSVMFGTGAKNNRQTKHQFY

SKVIQLLEESTQINSVEQLASIILKAGDCDSYRKLRIRCSRKGATPSILKIVQDYELGTNHDDE

VNVPSLIANLKEKLGRFEYECEWKCMEKIKAFLASKVGPYYLGSYSAMLENALSPIKGMTTKNC

KFVLKQIDAKNDIKYENEPFGKIVEGFFDSPYFESDTNVKWVLHPHHIGESNIKTLWEDLNAIH

SKYEEDIASLSEDKKEKRIKVYQGDVCQTINTYCEEVGKEAKTPLVQLLRYLYSRKDDIAVDKI

IDGITFLSKKHKVEKQKINPVIQKYPSFNFGNNSKLLGKIISPKDKLKHNLKCNRNQVDNYIWI

EIKVLNTKTMRWEKHHYALSSTRFLEEVYYPATSENPPDALAARFRTKTNGYEGKPALSAEQIE

QIRSAPVGLRKVKKRQMRLEAARQQNLLPRYTWGKDFNINICKRGNNFEVTLATKVKKKKEKNY

KVVLGYDANIVRKNTYAAIEAHANGDGVIDYNDIPVKPIESGFVTVESQVRDKSYDQLSYNGVK

LLYCKPHVESRRSFLEKYRNGTMKDNRGNNIQIDFMKDFEAIADDETSLYYFNMKYCKLLQSSI

RNHSSQAKEYREEIFELLRDGKLSVLKLSSLSNLSFVMFKVAKSLIGTYFGHLLKKPKNSKSDV

KAPPITDEDKQKADPEMFALRLALEEKRLNKVKSKKEVIANKIVAKALELRDKYGPVLIKGENI

SDTTKKGKKSSTNSFLMDWLARGVANKVKEMVMMHQGLEFVEVNPNFTSHQDPFVHKNPENTFR

ARYSRCTPSELTEKNRKEILSFLSDKPSKRPTNAYYNEGAMAFLATYGLKKNDVLGVSLEKFKQ

-continued
IMANILHQRSEDQLLFPSRGGMFYLATYKLDADATSVNWNGKQFWVCNADLVAAYNVGLVDIQK

DFKKK

Cas12i2
MSSAIKSYKSVLRPNERKNQLLKSTIQCLEDGSAFFFKMLQGLFGGITPEIVRFSTEQEKQQQD

IALWCAVNWFRPVSQDSLTHTIASDNLVEKFEEYYGGTASDAIKQYFSASIGESYYWNDCRQQY

YDLCRELGVEVSDLTHDLEILCREKCLAVATESNQNNSIISVLFGTGEKEDRSVKLRITKKILE

AISNLKEIPKNVAPIQEIILNVAKATKETFRQVYAGNLGAPSTLEKFIAKDGQKEFDLKKLQTD

LKKVIRGKSKERDWCCQEELRSYVEQNTIQYDLWAWGEMFNKAHTALKIKSTRNYNFAKQRLEQ

FKEIQSLNNLLVVKKLNDFFDSEFFSGEETYTICVHHLGGKDLSKLYKAWEDDPADPENAIVVI

CDDLKNNFKKEPIRNILRYIFTIRQECSAQDILAAAKYNQQLDRYKSQKANPSVLGNQGFTWTN

AVILPEKAQRNDRPNSLDLRIWLYLKLRHPDGRWKKHHIPFYDTRFFQEIYAAGNSPVDTCQFR

TPRFGYHLPKLTDQTAIRVNKKHVKAAKTEARIRLAIQQGTLPVSNLKITEISATINSKGQVRI

PVKFDVGRQKGTLQIGDRFCGYDQNQTASHAYSLWEVVKEGQYHKELGCFVRFISSGDIVSITE

NRGNQFDQLSYEGLAYPQYADWRKKASKFVSLWQITKKNKKKEIVTVEAKEKFDAICKYQPRLY

KFNKEYAYLLRDIVRGKSLVELQQIRQEIFRFIEQDCGVTRLGSLSLSTLETVKAVKGIIYSYE

STALNASKNNPISDEQRKEFDPELFALLEKLELIRTRKKKQKVERIANSLIQTCLENNIKFIRG

EGDLSTTNNATKKKANSRSMDWLARGVFNKIRQLAPMHNITLFGCGSLYTSHQDPLVHRNPDKA

MKCRWAAIPVKDIGDWVLRKLSQNLRAKNIGTGEYYHQGVKEFLSHYELQDLEEELLKWRSDRK

SNIPCWVLQNRLAEKLGNKEAVVYIPVRGGRIYFATHKVATGAVSIVFDQKQVWVCNADHVAAA

NIALTVKGIGEQSSDEENPDGSRIKLQLTS

Representative nucleic acid and protein sequences of the base editors follow:

BhCas12b GGSGG-ABE8-Xten20 at P153 ("GGSGGS" is disclosed as SEQ ID NO: 273)
(SEQ ID NO: 274)
GCCACCATGGCCCCAAAGAAGAAGCGGAAGGTCGGTATCCACGGAGTCCCAGCAGCCGCCACCA

GATCCTTCATCCTGAAGATCGAGCCCAACGAGGAAGTGAAGAAAGGCCTCTGGAAAACCCACGA

GGTGCTGAACCACGGAATCGCCTACTACATGAATATCCTGAAGCTGATCCGGCAAGAGGCCATC

TACGAGCACCACGAGCAGGACCCCAAGAATCCCAAGAAGGTGTCCAAGGCCGAGATCCAGGCCG

AGCTGTGGGATTTCGTGCTGAAGATGCAGAAGTGCAACAGCTTCACACACGAGGTGGACAAGGA

CGAGGTGTTCAACATCCTGAGAGAGCTGTACGAGGAACTGGTGCCCAGCAGCGTGGAAAAGAAG

GGCGAAGCCAACCAGCTGAGCAACAAGTTTCTGTACCCTCTGGTGGACCCCAACAGCCAGTCTG

GAAAGGGAACAGCCAGCAGCGGCAGAAAGCCCAGATGGTACAACCTGAAGATTGCCGGCGATCC

Cggaggctctggaggaagc TCCGAAGTCGAGTTTTCCCATGAGTACTGGATGAGACACGCATTG

ACTCTCGCAAAGAGGGCTCGAGATGAACGCGAGGTGCCCGTGGGGGGCAGTACTCGTGCTCAACA

ATCGCGTAATCGGCGAAGGTTGGAATAGGGCAATCGGACTCCACGACCCCACTGCACATGCGGA

AATCATGGCCCCTTCGACAGGGAGGGCTTGTGATGCAGAATTATCGACTTTATGATGCGACGCTG

TACGTCACGTTTGAACCTTGCGTAATGTGCGCGGGAGCTATGATTCACTCCCGCATTGGACGAG

TTGTATTCGGTGTTCGCAACGCCAAGACGGGTGCCGCAGGTTCACTGATGGACGTGCTGCATCA

-continued

TCCAGGCATGAACCACCGGGTAGAAATCACAGAAGGCATATTGGCGGACGAATGTGCGGCGCTG

TTGTGTCGTTTTTTTCGCATGCCCAGGCGGGTCTTTAACGCCCAGAAAAAAGCACAATCCTCTA

CTGAGGCTCTTCTGGATCTGAAACACCTGGCACAAGCGAGAGCGCCACCCCTGAGAGCTCTGG

CTCCTGGGAAGAAGAGAAGAAGAAGTGGGAAGAAGATAAGAAAAAGGACCCGCTGGCCAAGATC

CTGGGCAAGCTGGCTGAGTACGGACTGATCCCTCTGTTCATCCCCTACACCGACAGCAACGAGC

CCATCGTGAAAGAAATCAAGTGGATGGAAAAGTCCCGGAACCAGAGCGTGCGGCGGCTGGATAA

GGACATGTTCATTCAGGCCCTGGAACGGTTCCTGAGCTGGGAGAGCTGGAACCTGAAAGTGAAA

GAGGAATACGAGAAGGTCGAGAAAGAGTACAAGACCCTGGAAGAGAGGATCAAAGAGGACATCC

AGGCTCTGAAGGCTCTGGAACAGTATGAGAAAGAGCGGCAAGAACAGCTGCTGCGGGACACCCT

GAACACCAACGAGTACCGGCTGAGCAAGAGAGGCCTTAGAGGCTGGCGGGAAATCATCCAGAAA

TGGCTGAAAATGGACGAGAACGAGCCCTCCGAGAAGTACCTGGAAGTGTTCAAGGACTACCAGC

GGAAGCACCCTAGAGAGGCCGGCGATTACAGCGTGTACGAGTTCCTGTCCAAGAAAGAGAACCA

CTTCATCTGGCGGAATCACCCTGAGTACCCCTACCTGTACGCCACCTTCTGCGAGATCGACAAG

AAAAAGAAGGACGCCAAGCAGCAGGCCACCTTCACACTGGCCGATCCTATCAATCACCCTCTGT

GGGTCCGATTCGAGGAAAGAAGCGGCAGCAACCTGAACAAGTACAGAATCCTGACCGAGCAGCT

GCACACCGAGAAGCTGAAGAAAAAGCTGACAGTGCAGCTGGACCGGCTGATCTACCCTACAGAA

TCTGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGCAT

CAAGTTCCCTCTGAAGGGCACACTCGGCGGAGCCAGAGTGCAGTTCGACAGAGATCACCTGAGA

AGATACCCTCACAAGGTGGAAAGCGGCAACGTGGGCAGAATCTACTTCAACATGACCGTGAACA

TCGAGCCTACAGAGTCCCCAGTGTCCAAGTCTCTGAAGATCCACCGGGACGACTTCCCCAAGGT

GGTCAACTTCAAGCCCAAAGAACTGACCGAGTGGATCAAGGACAGCAAGGGCAAGAAACTGAAG

TCCGGCATCGAGTCCCTGGAAATCGGCCTGAGAGTGATGAGCATCGACCTGGGACAGAGACAGG

CCGCTGCCGCCTCTATTTTCGAGGTGGTGGATCAGAAGCCCGACATCGAAGGCAAGCTGTTTTT

CCCAATCAAGGGCACCGAGCTGTATGCCGTGCACAGAGCCCAGCTTCAACATCAAGCTGCCCGGC

GAGACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAGAG

AGAGAAGCGGGTCACCAAGTGGATCAGCAGACAAGAGAACAGCGACGTGCCCCTGGTGTACCAG

GATGAGCTGATCCAGATCCGCGAGCTGATGTACAAGCCTTACAAGGACTGGGTCGCCTTCCTGA

AGCAGCTCCACAAGAGACTGGAAGTCGAGATCGGCAAAGAAGTGAAGCACTGGCGGAAGTCCCT

GAGCGACGGAAGAAAGGGCCTGTACGGCATCTCCCTGAAGAACATCGACGAGATCGATCGGACC

CGGAAGTTCCTGCTGAGATGGTCCCTGAGGCCTACCGAACCTGGCGAAGTGCGTAGACTGGAAC

CCGGCCAGAGATTCGCCATCGACCAGCTGAATCACCTGAACGCCCTGAAAGAAGATCGGCTGAA

GAAGATGGCCAACACCATCATCATGCACGCCCTGGGCTACTGCTACGACGTGCGGAAGAAGAAA

TGGCAGGCTAAGAACCCCGCCTGCCAGATCATCCTGTTCGAGGATCTGAGCAACTACAACCCCT

ACGAGGAAAGGTCCCGCTTCGAGAACAGCAAGCTCATGAAGTGGTCCAGACGCGAGATCCCCAG

ACAGGTTGCACTGCAGGGCGAGATCTATGGCCTGCAAGTGGGAGAAGTGGGCGCTCAGTTCAGC

AGCAGATTCCACGCCAAGCACAGGCAGCCCTGGCATCAGATGTAGCGTCGTGACCAAAGAGAAGC

TGCAGGACAATCGGTTCTTCAAGAATCTGCAGAGAGAGGGCAGACTGACCCTGGACAAAATCGC

-continued

```
CGTGCTGAAAGAGGGCGATCTGTACCCAGACAAAGGCGGCGAGAAGTTCATCAGCCTGAGCAAG

GATCGGAAGTGCGTGACCACACACGCCGACATCAACGCCGCTCAGAACCTGCAGAAGCGGTTCT

GGACAAGAACCCACGGCTTCTACAAGGTGTACTGCAAGGCCTACCAGGTGGACGGCCAGACCG

TGTACATCCCTGAGAGCAAGGACCAGAAGCAGAAGATCATCGAAGAGTTCGGCGAGGGCTACT

TCATTCTGAAGGACGGGGTGTACGAATGGGTCAACGCCGGCAAGCTGAAAATCAAGAAGGGCAG

CTCCAAGCAGAGCAGCAGCGAGCTGGTGGATAGCGACATCCTGAAAGACAGCTTCGACCTGGCC

TCCGAGCTGAAAGGCGAAAAGCTGATGCTGTACAGGGACCCCAGCGGCAATGTGTTCCCCAGCG

ACAAATGGATGGCCGCTGGCGTGTTCTTCGGAAAGCTGGAACGCATCCTGATCAGCAAGCTGAC

CAACCAGTACTCCATCAGCACCATCGAGGACGACAGCAGCAAGCAGTCTATGAAAAGGCCGGCG
```

GCCACGAAAAAGGCCGGCCAGGCAAAAAAGAAAAAGGGATCC*TACCCATACGATGTTCCAGATT*

*ACGCTTATCCCTACGACGTGCCTGATTATGCATACCCATATGATGTCCCCGACTATGCCTAA*

(SEQ ID NO: 275)

```
MAPKKKRKVGIHGVPAAATRSFILKIEPNEEVKKGLWKTHEVLNHGIAYYMNILKLIRQEAIYE

HHEQDPKNPKKVSKAEIQAELWDFVLKMQKCNSFTHEVDKDEVFNILRELYEELVPSSVEKKGE

ANQLSNKFLYPLVDPNSQSGKGTASSGRKPRWYNLKIAGDPGGSGGSSEVEFSHEYWMRHALTL

AKRARDEREVPVGAVLVLNNRVIGEGWNRAIGLHDPTAHAEIMALRQGGLVMQNYRLYDATLYV

TFEPCVMCAGAMIHSRIGRVVFGVRNAKTGAAGSLMDVLHHPGMNHRVEITEGILADECAALLC

RFFRMPRRVFNAQKKAQSSTDGSSGSETPGTSESATPESSGSWEEEKKKWEEDKKKDPLAKILG

KLAEYGLIPLFIPYTDSNEPIVKEIKWMEKSRNQSVRRLDKDMFIQALERFLSWESWNLKVKEE

YEKVEKEYKTLEERIKEDIQALKALEQYEKERQEQLLRDTLNTNEYRLSKRGLRGWREIIQKWL

KMDENEPSEKYLEVFKDYQRKHPREAGDYSVYEFLSKKENHFIWRNHPEYPYLYATFCEIDKKK

KDAKQQATFTLADPINHPLWVRFEERSGSNLNKYRILTEQLHTEKLKKKLTVQLDRLIYPTESG

GWEEKGKVDIVLLPSRQFYNQIFLDIEEKGKHAFTYKDESIKFPLKGTLGGARVQFDRDHLRRY

PHKVESGNVGRIYFNMTVNIEPTESPVSKSLKIHRDDFPKVVNFKPKELTEWIKDSKGKKLKSG

IESLEIGLRVMSIDLGORQAAAASIFEVVDQKPDIEGKLFFPIKGTELYAVHRASFNIKLPGET

LVKSREVLRKAREDNLKLMNQKLNFLRNVLHFQQFEDITEREKRVTKWISRQENSDVPLVYQDE

LIQIRELMYKPYKDWVAFLKQLHKRLEVEIGKEVKHWRKSLSDGRKGLYGISLKNIDEIDRTRK

FLLRWSLRPTEPGEVRRLEPGQRFAIDQLNHLNALKEDRLKKMANTIIMHALGYCYDVRKKKWQ

AKNPACQIILFEDLSNYNPYEERSRFENSKLMKWSRREIPROVALQGEIYGLQVGEVGAQFSSR

FHAKTGSPGIRCSVVTKEKLQDNRFFKNLQREGRLTLDKIAVLKEGDLYPDKGGEKFISLSKDR

KCVTTHADINAAQNLQKRFWTRTHGFYKVYCKAYQVDGQTVYIPESKDQKQKIIEEFGEGYFIL

KDGVYEWVNAGKLKIKKGSSKQSSSELVDSDILKDSFDLASELKGEKLMLYRDPSGNVFPSDKW

MAAGVFFGKLERILISKLTNQYSISTIEDDSSKQSMKRPAATKKAGQAKKKKGSYPYDVPDYAY

PYDVPDYAYPYDVPDYA
```

BhCas12b GGSGGS-ABE8-Xten20 at K255 ("GGSGGS" is disclosed as SEQ ID NO: 273)

(SEQ ID NO: 276)

GCCACCATGGCCCCAAAGAAAGAAGCGGAAGGTCGGTATCCACGGAGTCCCAGCAGCCGCCACCA

```
GATCCTTCATCCTGAAGATCGAGCCCAACGAGGAAGTGAAGAAAGGCCTCTGGAAAACCCACGA

GGTGCTGAACCACGGAATCGCCTACTACATGAATATCCTGAAGCTGATCCGGCAAGAGGCCATC

TACGAGCACCACGAGCAGGACCCCAAGAATCCCAAGAAGGTGTCCAAGGCCGAGATCCAGGCCG

AGCTGTGGGATTTCGTGCTGAAGATGCAGAAGTGCAACAGCTTCACACACGAGGTGGACAAGGA
```

-continued

```
CGAGGTGTTCAACATCCTGAGAGAGCTGTACGAGGAACTGGTGCCCAGCAGCGTGGAAAAGAAG

GGCGAAGCCAACCAGCTGAGCAACAAGTTTCTGTACCCTCTGGTGGACCCCAACAGCCAGTCTG

GAAAGGGAACAGCCAGCAGCGGCAGAAAGCCCAGATGGTACAACCTGAAGATTGCCGGCGATCC

CTCCTGGGAAGAAGAGAAGAAGAAGTGGGAAGAAGATAAGAAAAAGGACCCGCTGGCCAAGATC

CTGGGCAAGCTGGCTGAGTACGGACTGATCCCTCTGTTCATCCCCTACACCGACAGCAACGAGC

CCATCGTGAAAGAAATCAAGTGGATGGAAAAGTCCCGGAACCAGAGCGTGCGGCGGCTGGATAA

GGACATGTTCATTCAGGCCCTGGAACGGTTCCTGAGCTGGGAGAGCTGGAACCTGAAAGTGAAA

GAGGAATACGAGAAGGTCGAGAAAGAGTACAAGACCCTGGAAGAGAGGATCAAAggaggctctg gaggaagcTCCGAAGTCGAGTTTTCCCATGAGTACTGGATGATGAGACACGCATTGACTCTCGCAAA

GAGGGCTCGAGATGAACGCGAGGTGCCCGTGGGGGCAGTACTCGTGCTCAACAATCGCGTAATC

GGCGAAGGTTGGAATAGGGCAATCGGACTCCACGACCCCACTGCACATGCGGAAATCATGGCCC

TTCGACAGGGAGGGCTTGTGATGCAGAATTATCGACTTTATGATGCGACGCTGTACGTCACGTT

TGAACCTTGCGTAATGTGCGCGGGAGCTATGATTCACTCCCGCATTGGACGAGTTGTATTCGGT

GTTCGCAACGCCAAGACGGGTGCCGCAGGTTCACTGATGGACGTGCTGCATCATCCAGGCATGA

ACCACCGGGTAGAAATCACAGAAGGCATATTGGCGGACGAATGTGCGGCGCTGTTGTGTCGTTT

TTTTCGCATGCCAGGCGGGTCTTTAACGCCCAGAAAAAAGCACAATCCTCTACTGACGGCTCT

TCTGGATCTGAAACACCTGGCACAAGCGAGAGCGCCACCCCTGAGAGCTCTGGCGAGGACATCC

AGGCTCTGAAGGCTCTGGAACAGTATGAGAAAGAGCGGCAAGAACAGCTGCTGCGGGACACCCT

GAACACCAACGAGTACCGGCTGAGCAAGAGAGGCCTTAGAGGCTGGCGGGAAATCATCCAGAAA

TGGCTGAAAATGGACGAGAACGAGCCCTCCGAGAAGTACCTGGAAGTGTTCAAGGACTACCAGC

GGAAGCACCCTAGAGAGGCCGGCGATTACAGCGTGTACGAGTTCCTGTCCAAGAAAGAGAACCA

CTTCATCTGGCGGAATCACCCTGAGTACCCCTACCTGTACGCCACCTTCTGCGAGATCGACAAG

AAAAAGAAGGACGCCAAGCAGCAGGCCACCTTCACACTGGCCGATCCTATCAATCACCCTCTGT

GGGTCCGATTCGAGGAAAGAAGCGGCAGCAACCTGAACAAGTACAGAATCCTGACCGAGCAGCT

GCACACCGAGAAGCTGAAGAAAAAGCTGACAGTGCAGCTGGACCGGCTGATCTACCCTACAGAA

TCTGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGCAT

CAAGTTCCCTCTGAAGGGCACACTCGGCGGAGCCAGAGTGCAGTTCGACAGAGATCACCTGAGA

AGATACCCTCACAAGGTGGAAAGCGGCAACGTGGGCAGAATCTACTTCAACATGACCGTGAACA

TCGAGCCTACAGAGTCCCCAGTGTCCAAGTCTCTGAAGATCCACCGGGACGACTTCCCCAAGGT

GGTCAACTTCAAGCCCAAAGAACTGACCGAGTGGATCAAGGACAGCAAGGGCAAGAAACTGAAG

TCCGGCATCGAGTCCCTGGAAATCGGCCTGAGAGTGATGAGCATCGACCTGGGACAGAGACAGG

CCGCTGCCGCCTCTATTTTCGAGGTGGTGGATCAGAAGCCCGACATCGAAGGCAAGCTGTTTTT

CCCAATCAAGGGCACCGAGCTGTATGCCGTGCACAGAGCCAGCTTCAACATCAAGCTGCCCGGC

GAGACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAGAG

AGAGAAGCGGGTCACCAAGTGGATCAGCAGACAAGAGAACAGCGACGTGCCCCTGGTGTACCAG
```

-continued

```
GATGAGCTGATCCAGATCCGCGAGCTGATGTACAAGCCTTACAAGGACTGGGTCGCCTTCCTGA

AGCAGCTCCACAAGAGACTGGAAGTCGAGATCGGCAAAGAAGTGAAGCACTGGCGGAAGTCCCT

GAGCGACGGAAGAAAGGGCCTGTACGGCATCTCCCTGAAGAACATCGACGAGATCGATCGGACC

CGGAAGTTCCTGCTGAGATGGTCCCTGAGGCCTACCGAACCTGGCGAAGTGCGTAGACTGGAAC

CCGGCCAGAGATTCGCCATCGACCAGCTGAATCACCTGAACGCCCTGAAAGAAGATCGGCTGAA

GAAGATGGCCAACACCATCATCATGCACGCCCTGGGCTACTGCTACGACGTGCGGAAGAAGAAA

TGGCAGGCTAAGAACCCCGCCTGCCAGATCATCCTGTTCGAGGATCTGAGCAACTACAACCCCT

ACGAGGAAAGGTCCCGCTTCGAGAACAGCAAGCTCATGAAGTGGTCCAGACGCGAGATCCCCAG

ACAGGTTGCACTGCAGGGCGAGATCTATGGCCTGCAAGTGGGAGAAGTGGGCGCTCAGTTCAGC

AGCAGATTCCACGCCAAGACAGGCAGCCCTGGCATCAGATGTAGCGTCGTGACCAAAGAGAAGC

TGCAGGACAATCGGTTCTTCAAGAATCTGCAGAGAGAGGGCAGACTGACCCTGGACAAAATCGC

CGTGCTGAAAGAGGGCGATCTGTACCCAGACAAAGGCGGCGAGAAGTTCATCAGCCTGAGCAAG

GATCGGAAGTGCGTGACCACACACGCCGACATCAACGCCGCTCAGAACCTGCAGAAGCGGTTCT

GGACAAGAACCCACGGCTTCTACAAGGTGTACTGCAAGGCCTACCAGGTGGACGGCCAGACCGT

GTACATCCCTGAGAGCAAGGACCAGAAGCAGAAGATCATCGAAGAGTTCGGCGAGGGCTACTTC

ATTCTGAAGGACGGGGTGTACGAATGGGTCAACGCCGGCAAGCTGAAAATCAAGAAGGGCAGCT

CCAAGCAGAGCAGCAGCGAGCTGGTGGATAGCGACATCCTGAAAGACAGCTTCGACCTGGCCTC

CGAGCTGAAAGGCGAAAAGCTGATGCTGTACAGGGACCCCAGCGGCAATGTGTTCCCCAGCGAC

AAATGGATGGCCGCTGGCGTGTTCTTCGGAAAGCTGGAACGCATCCTGATCAGCAAGCTGACCA

ACCAGTACTCCATCAGCACCATCGAGGACGACAGCAGCAAGCAGTCTATGAAAAGGCCGGCGGC

CACGAAAAAGGCCGGCCAGGCAAAAAAGAAAAAGGGATCCTACCCATACGATGTTCCAGATTAC
                                          -------

GCTTATCCCTACGACGTGCCTGATTATGCATACCCATATGATGTCCCCGACTATGCCTAA
```

(SEQ ID NO: 277)

```
MAPKKKRKVGIHGVPAAATRSFILKIEPNEEVKKGLWKTHEVLNHGIAYYMNILKLIRQEAIYE

HHEQDPKNPKKVSKAEIQAELWDFVLKMQKCNSFTHEVDKDEVFNILRELYEELVPSSVEKKGE

ANQLSNKFLYPLVDPNSQSGKGTASSGRKPRWYNLKIAGDPSWEEEKKKWEEDKKKDPLAKILG

KLAEYGLIPLFIPYTDSNEPIVKEIKWMEKSRNQSVRRLDKDMFIQALERFLSWESWNLKVKEE

YEKVEKEYKTLEERIKGGSGGSSEVEFSHEYWMRHALTLAKRARDEREVPVGAVLVLNNRVIGE

GWNRAIGLHDPTAHAEIMALRQGGLVMQNYRLYDATLYVTFEPCVMCAGAMIHSRIGRVVFGVR

NAKTGAAGSLMDVLHHPGMNHRVEITEGILADECAALLCRFFRMPRRVFNAQKKAQSSTDGSSG

SETPGTSESATPESSGEDIQALKALEQYEKERQEQLLRDTLNTNEYRLSKRGLRGWREIIQKWL

KMDENEPSEKYLEVFKDYQRKHPREAGDYSVYEFLSKKENHFIWRNHPEYPYLYATFCEIDKKK

KDAKQQATFTLADPINHPLWVRFEERSGSNLNKYRILTEQLHTEKLKKKLTVQLDRLIYPTESG

GWEEKGKVDIVLLPSRQFYNQIFLDIEEKGKHAFTYKDESIKFPLKGTLGGARVQFDRDHLRRY

PHKVESGNVGRIYFNMTVNIEPTESPVSKSLKIHRDDFPKVVNFKPKELTEWIKDSKGKKLKSG

IESLEIGLRVMSIDLGQRQAAAASIFEVVDQKPDIEGKLFFPIKGTELYAVHRASFNIKLPGET

LVKSREVLRKAREDNLKLMNQKLNFLRNVLHFQQFEDITEREKRVTKWISRQENSDVPLVYQDE

LIQIRELMYKPYKDWVAFLKQLHKRLEVEIGKEVKHWRKSLSDGRKGLYGISLKNIDEIDRTRK

FLLRWSLRPTEPGEVRRLEPGQRFAIDQLNHLNALKEDRLKKMANTIIMHALGYCYDVRKKKWQ

AKNPACQIILFEDLSNYNPYEERSRFENSKLMKWSRREIPRQVALQGEIYGLQVGEVGAQFSSR

FHAKTGSPGIRCSVVTKEKLQDNRFFKNLQREGRLTLDKIAVLKEGDLYPDKGGEKFISLSKDR
```

KCVTTHADINAAQNLQKRFWTRTHGFYKVYCKAYQVDGQTVYIPESKDQKQKIIEEFGEGYFIL

KDGVYEWVNAGKLKIKKGSSKQSSSELVDSDILKDSFDLASELKGEKLMLYRDPSGNVFPSDKW

MAAGVFFGKLERILISKLTNQYSISTIEDDSSKQSMKRPAATKKAGQAKKKKGSYPYDVPDYAY

PYDVPDYAYPYDVPDYA

BhCas 12b GGSGGS-ABE8-Xten20 at D306 ("GGSGGS" is disclosed as SEQ ID NO: 273)
(SEQ ID NO: 278)
GCCACCATGGCCCCAAAGAAGAAGCGGAAGGTCGGTATCCACGGAGTCCCAGCAGCCGCCACCA

GATCCTTCATCCTGAAGATCGAGCCCAACGAGGAAGTGAAGAAAGGCCTCTGGAAAACCCACGA

GGTGCTGAACCACGGAATCGCCTACTACATGAATATCCTGAAGCTGATCCGGCAAGAGGCCATC

TACGAGCACCACGAGCAGGACCCCAAGAATCCCAAGAAGGTGTCCAAGGCCGAGATCCAGGCCG

AGCTGTGGGATTTCGTGCTGAAGATGCAGAAGTGCAACAGCTTCACACACGAGGTGGACAAGGA

CGAGGTGTTCAACATCCTGAGAGAGCTGTACGAGGAACTGGTGCCCAGCAGCGTGGAAAAGAAG

GGCGAAGCCAACCAGCTGAGCAACAAGTTTCTGTACCCTCTGGTGGACCCCAACAGCCAGTCTG

GAAAGGGAACAGCCAGCAGCGGCAGAAAGCCCAGATGGTACAACCTGAAGATTGCCGGCGATCC

CTCCTGGGAAGAAGAGAAGAAGAAGTGGGAAGAAGATAAGAAAAAGGACCCGCTGGCCAAGATC

CTGGGCAAGCTGGCTGAGTACGGACTGATCCCTCTGTTCATCCCCTACACCGACAGCAACGAGC

CCATCGTGAAAGAAATCAAGTGGATGGAAAAGTCCCGGAACCAGAGCGTGCGGCGGCTGGATAA

GGACATGTTCATTCAGGCCCTGGAACGGTTCCTGAGCTGGGAGAGCTGGAACCTGAAAGTGAAA

GAGGAATACGAGAAGGTCGAGAAAGAGTACAAGACCCTGGAAGAGAGGATCAAAGAGGACATCC

AGGCTCTGAAGGCTCTGGAACAGTATGAGAAAGAGCGGCAAGAACAGCTGCTGCGGGACACCCT

GAACACCAACGAGTACCGGCTGAGCAAGAGAGGCCTTAGAGGCTGGCGGGAAATCATCCAGAAA

TGGCTGAAAATGGACggaggctctggaggaagcTCCGAAGTCGAGTTTTCCCATGAGTACTGGA

TGAGACACGCATTGACTCTCGCAAAGAGGGCTCGAGATGAACGCGAGGTGCCCGTGGGGGCAGT

ACTCGTGCTCAACAATCGCGTAATCGGCGAAGGTTGGAATAGGGCAATCGGACTCCACGACCCC

ACTGCACATGCGGAAATCATGGCCCTTCGACAGGGAGGGCTTGTGATGCAGAATTATCGACTTT

ATGATGCGACGCTGTACGTCACGTTTGAACCTTGCGTAATGTGCGCGGGAGCTATGATTCACTC

CCGCATTGGACGAGTTGTATTCGGTGTTCGCAACGCCAAGACGGGTGCCGCAGGTTCACTGATG

GACGTGCTGCATCATCCAGGCATGAACCACCGGGTAGAAATCACAGAAGGCATATTGGCGGACG

AATGTGCGGCGCTGTTGTGTCGTTTTTTTCGCATGCCCAGGCGGGTCTTTAACGCCCAGAAAAA

AGCACAATCCTCTACTGACGGCTCTTCTGGATCTGAAACACCTGGCACAAGCGAGAGCGCCACC

CCTGAGAGCTCTGGCGAGAACGAGCCCTCCGAGAAGTACCTGGAAGTGTTCAAGGACTACCAGC

GGAAGCACCCTAGAGAGGCCGGCGATTACAGCGTGTACGAGTTCCTGTCCAAGAAAGAGAACCA

CTTCATCTGGCGGAATCACCCTGAGTACCCCTACCTGTACGCCACCTTCTGCGAGATCGACAAG

AAAAAGAAGGACGCCAAGCAGCAGGCCACCTTCACACTGGCCGATCCTATCAATCACCCTCTGT

GGGTCCGATTCGAGGAAAGAAGCGGCAGCAACCTGAACAAGTACAGAATCCTGACCGAGCAGCT

GCACACCGAGAAGCTGAAGAAAAAGCTGACAGTGCAGCTGGACCGGCTGATCTACCCTACAGAA

TCTGGCGGCTGGGAAGAGAAGGGCAAAGTGGACATTGTGCTGCTGCCCAGCCGGCAGTTCTACA

-continued

```
ACCAGATCTTCCTGGACATCGAGGAAAAGGGCAAGCACGCCTTCACCTACAAGGATGAGAGCAT

CAAGTTCCCTCTGAAGGGCACACTCGGCGGAGCCAGAGTGCAGTTCGACAGAGATCACCTGAGA

AGATACCCTCACAAGGTGGAAAGCGGCAACGTGGGCAGAATCTACTTCAACATGACCGTGAACA

TCGAGCCTACAGAGTCCCCAGTGTCCAAGTCTCTGAAGATCCACCGGGACGACTTCCCCAAGGT

GGTCAACTTCAAGCCCAAAGAACTGACCGAGTGGATCAAGGACAGCAAGGGCAAGAAACTGAAG

TCCGGCATCGAGTCCCTGGAAATCGGCCTGAGAGTGATGAGCATCGACCTGGGACAGAGACAGG

CCGCTGCCGCCTCTATTTTCGAGGTGGTGGATCAGAAGCCCGACATCGAAGGCAAGCTGTTTTT

CCCAATCAAGGGCACCGAGCTGTATGCCGTGCACAGAGCCAGCTTCAACATCAAGCTGCCCGGC

GAGACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAGAG

AGAGAAGCGGGTCACCAAGTGGATCAGCAGACAAGAGAACAGCGACGTGCCCCTGGTGTACCAG

GATGAGCTGATCCAGATCCGCGAGCTGATGTACAAGCCTTACAAGGACTGGGTCGCCTTCCTGA

AGCAGCTCCACAAGAGACTGGAAGTCGAGATCGGCAAAGAAGTGAAGCACTGGCGGAAGTCCCT

GAGCGACGGAAGAAAGGGCCTGTACGGCATCTCCCTGAAGAACATCGACGAGATCGATCGGACC

CGGAAGTTCCTGCTGAGATGGTCCCTGAGGCCTACCGAACCTGGCGAAGTGCGTAGACTGGAAC

CCGGCCAGAGATTCGCCATCGACCAGCTGAATCACCTGAACGCCCTGAAAGAAGATCGGCTGAA

GAAGATGGCCAACACCATCATCATGCACGCCCTGGGCTACTGCTACGACGTGCGGAAGAAGAAA

TGGCAGGCTAAGAACCCCGCCTGCCAGATCATCCTGTTCGAGGATCTGAGCAACTACAACCCCT

ACGAGGAAAGGTCCCGCTTCGAGAACAGCAAGCTCATGAAGTGGTCCAGACGCGAGATCCCCAG

ACAGGTTGCACTGCAGGGCGAGATCTATGGCCTGCAAGTGGGAGAAGTGGGCGCTCAGTTCAGC

AGCAGATTCCACGCCAAGACAGGCAGCCCTGGCATCAGATGTAGCGTCGTGACCAAAGAGAAGC

TGCAGGACAATCGGTTCTTCAAGAATCTGCAGAGAGAGGGCAGACTGACCCTGGACAAAATCGC

CGTGCTGAAAGAGGGCGATCTGTACCCAGACAAAGGCGGCGAGAAGTTCATCAGCCTGAGCAAG

GATCGGAAGTGCGTGACCACACACGCCGACATCAACGCCGCTCAGAACCTGCAGAAGCGGTTCT

GGACAAGAACCCACGGCTTCTACAAGGTGTACTGCAAGGCCTACCAGGTGGACGGCCAGACCGT

GTACATCCCTGAGAGCAAGGACCAGAAGCAGAAGATCATCGAAGAGTTCGGCGAGGGCTACTTC

ATTCTGAAGGACGGGGTGTACGAATGGGTCAACGCCGGCAAGCTGAAAATCAAGAAGGGCAGCT

CCAAGCAGAGCAGCAGCGAGCTGGTGGATAGCGACATCCTGAAAGACAGCTTCGACCTGGCCTC

CGAGCTGAAAGGCGAAAAGCTGATGCTGTACAGGGACCCCAGCGGCAATGTGTTCCCCAGCGAC

AAATGGATGGCCGCTGGCGTGTTCTTCGGAAAGCTGGAACGCATCCTGATCAGCAAGCTGACCA

ACCAGTACTCCATCAGCACCATCGAGGACGACAGCAGCAAGCAGTCTATG̲A̲A̲A̲A̲G̲G̲C̲C̲G̲G̲C̲G̲G̲C̲

C̲A̲C̲G̲A̲A̲A̲A̲A̲G̲G̲C̲C̲G̲G̲C̲C̲A̲G̲G̲C̲A̲A̲A̲A̲A̲A̲G̲A̲A̲A̲A̲A̲G̲G̲GATCC̲TACCCATACGATGTTCCAGATTAC

GCTTATCCCTACGACGTGCCTGATTATGCATACCCATATGATGTCCCCGACTATGCCTAA
```

(SEQ ID NO: 279)

```
MAPKKKRKVGIHGVPAAATRSFILKIEPNEEVKKGLWKTHEVLNHGIAYYMNILKLIRQEAIYE

HHEQDPKNPKKVSKAEIQAELWDFVLKMQKCNSFTHEVDKDEVFNILRELYEELVPSSVEKKGE

ANQLSNKFLYPLVDPNSQSGKGTASSGRKPRWYNLKIAGDPSWEEEKKKWEEDKKKDPLAKILG

KLAEYGLIPLFIPYTDSNEPIVKEIKWMEKSRNQSVRRLDKDMFIQALERFLSWESWNLKVKEE

YEKVEKEYKTLEERIKEDIQALKALEQYEKERQEQLLRDTLNTNEYRLSKRGLRGWREIIQKWL

KMDGGSGGSSEVEFSHEYWMRHALTLAKRARDEREVPVGAVLVLNNRVIGEGWNRAIGLHDPTA
```

-continued

```
HAEIMALRQGGLVMQNYRLYDATLYVTFEPCVMCAGAMIHSRIGRVVFGVRNAKTGAAGSLMDV

LHHPGMNHRVEITEGILADECAALLCRFFRMPRRVFNAQKKAQSSTDGSSGSETPGTSESATPE

SSGENEPSEKYLEVFKDYQRKHPREAGDYSVYEFLSKKENHFIWRNHPEYPYLYATFCEIDKKK

KDAKQQATFTLADPINHPLWVRFEERSGSNLNKYRILTEQLHTEKLKKKLTVQLDRLIYPTESG

GWEEKGKVDIVLLPSRQFYNQIFLDIEEKGKHAFTYKDESIKFPLKGTLGGARVQFDRDHLRRY

PHKVESGNVGRIYFNMTVNIEPTESPVSKSLKIHRDDFPKVVNFKPKELTEWIKDSKGKKLKSG

IESLEIGLRVMSIDLGQRQAAAASIFEVVDQKPDIEGKLFFPIKGTELYAVHRASFNIKLPGET

LVKSREVLRKAREDNLKLMNQKLNFLRNVLHFQQFEDITEREKRVTKWISRQENSDVPLVYQDE

LIQIRELMYKPYKDWVAFLKQLHKRLEVEIGKEVKHWRKSLSDGRKGLYGISLKNIDEIDRTRK

FLLRWSLRPTEPGEVRRLEPGQRFAIDQLNHLNALKEDRLKKMANTIIMHALGYCYDVRKKKWQ

AKNPACQIILFEDLSNYNPYEERSRFENSKLMKWSRREIPROVALQGEIYGLQVGEVGAQFSSR

FHAKTGSPGIRCSVVTKEKLQDNRFFKNLQREGRLTLDKIAVLKEGDLYPDKGGEKFISLSKDR

KCVTTHADINAAQNLQKRFWTRTHGFYKVYCKAYQVDGQTVYIPESKDQKQKIIEEFGEGYFIL

KDGVYEWVNAGKLKIKKGSSKQSSSELVDSDILKDSFDLASELKGEKLMLYRDPSGNVFPSDKW

MAAGVFFGKLERILISKLTNQYSISTIEDDSSKQSMKRPAATKKAGQAKKKKGSYPYDVPDYAY

PYDVPDYAYPYDVPDYA
```

BhCas12b GGSGGS-ABE8-Xten20 at D980 ("GGSGGS" is disclosed as SEQ ID NO: 273)

(SEQ ID NO: 280)

```
GCCACCATGGCCCCAAAGAAGAAGCGGAAGGTCGGTATCCACGGAGTCCCAGCAGCCGCCACC

GATCCTTCATCCTGAAGATCGAGCCCAACGAGGAAGTGAAGAAAGGCCTCTGGAAAACCCACGA

GGTGCTGAACCACGGAATCGCCTACTACATGAATATCCTGAAGCTGATCCGGCAAGAGGCCATC

TACGAGCACCACGAGCAGGACCCCAAGAATCCCAAGAAGGTGTCCAAGGCCGAGATCCAGGCCG

AGCTGTGGGATTTCGTGCTGAAGATGCAGAAGTGCAACAGCTTCACACACGAGGTGGACAAGGA

CGAGGTGTTCAACATCCTGAGAGAGCTGTACGAGGAACTGGTGCCCAGCAGCGTGGAAAAGAAG

GGCGAAGCCAACCAGCTGAGCAACAAGTTTCTGTACCCTCTGGTGGACCCCAACAGCCAGTCTG

GAAAGGGAACAGCCAGCAGCGGCAGAAAGCCCAGATGGTACAACCTGAAGATTGCCGGCGATCC

CTCCTGGGAAGAAGAGAAGAAGAAGTGGGAAGAAGATAAGAAAAAGGACCCGCTGGCCAAGATC

CTGGGCAAGCTGGCTGAGTACGGACTGATCCCTCTGTTCATCCCCTACACCGACAGCAACGAGC

CCATCGTGAAAGAAATCAAGTGGATGGAAAAGTCCCGGAACCAGAGCGTGCGGCGGCTGGATAA

GGACATGTTCATTCAGGCCCTGGAACGGTTCCTGAGCTGGGAGAGCTGGAACCTGAAAGTGAAA

GAGGAATACGAGAAGGTCGAGAAAGAGTACAAGACCCTGGAAGAGAGGATCAAAGAGGACATCC

AGGCTCTGAAGGCTCTGGAACAGTATGAGAAAGAGCGGCAAGAACAGCTGCTGCGGGACACCCT

GAACACCAACGAGTACCGGCTGAGCAAGAGAGGCCTTAGAGGCTGGCGGGAAATCATCCAGAAA

TGGCTGAAAATGGACGAGAACGAGCCCTCCGAGAAGTACCTGGAAGTGTTCAAGGACTACCAGC

GGAAGCACCCTAGAGAGGCCGGCGATTACAGCGTGTACGAGTTCCTGTCCAAGAAAGAGAACCA

CTTCATCTGGCGGAATCACCCTGAGTACCCCTACCTGTACGCCACCTTCTGCGAGATCGACAAG

AAAAAGAAGGACGCCAAGCAGCAGGCCACCTTCACACTGGCCGATCCTATCAATCACCCTCTGT

GGGTCCGATTCGAGGAAAGAAGCGGCAGCAACCTGAACAAGTACAGAATCCTGACCGAGCAGCT

GCACACCGAGAAGCTGAAGAAAAAGCTGACAGTGCAGCTGGACCGGCTGATCTACCCTACAGAA

TCTGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGCAT
```

CAAGTTCCCTCTGAAGGGCACACTCGGCGGAGCCAGAGTGCAGTTCGACAGAGATCACCTGAGA

AGATACCCTCACAAGGTGGAAAGCGGCAACGTGGGCAGAATCTACTTCAACATGACCGTGAACA

TCGAGCCTACAGAGTCCCCAGTGTCCAAGTCTCTGAAGATCCACCGGGACGACTTCCCCAAGGT

GGTCAACTTCAAGCCCAAAGAACTGACCGAGTGGATCAAGGACAGCAAGGGCAAGAAACTGAAG

TCCGGCATCGAGTCCCTGGAAATCGGCCTGAGAGTGATGAGCATCGACCTGGGACAGAGACAGG

CCGCTGCCGCCTCTATTTTCGAGGTGGTGGATCAGAAGCCCGACATCGAAGGCAAGCTGTTTTT

CCCAATCAAGGGCACCGAGCTGTATGCCGTGCACAGAGCCAGCTTCAACATCAAGCTGCCCGGC

GAGACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAGAG

AGAGAAGCGGGTCACCAAGTGGATCAGCAGACAAGAGAACAGCGACGTGCCCCTGGTGTACCAG

GATGAGCTGATCCAGATCCGCGAGCTGATGTACAAGCCTTACAAGGACTGGGTCGCCTTCCTGA

AGCAGCTCCACAAGAGACTGGAAGTCGAGATCGGCAAAGAAGTGAAGCACTGGCGGAAGTCCCT

GAGCGACGGAAGAAAGGGCCTGTACGGCATCTCCCTGAAGAACATCGACGAGATCGATCGGACC

CGGAAGTTCCTGCTGAGATGGTCCCTGAGGCCTACCGAACCTGGCGAAGTGCGTAGACTGGAAC

CCGGCCAGAGATTCGCCATCGACCAGCTGAATCACCTGAACGCCCTGAAAGAAGATCGGCTGAA

GAAGATGGCCAACACCATCATCATGCACGCCCTGGGCTACTGCTACGACGTGCGGAAGAAGAAA

TGGCAGGCTAAGAACCCCGCCTGCCAGATCATCCTGTTCGAGGATCTGAGCAACTACAACCCCT

ACGAGGAAAGGTCCCGCTTCGAGAACAGCAAGCTCATGAAGTGGTCCAGACGCGAGATCCCCAG

ACAGGTTGCACTGCAGGGCGAGATCTATGGCCTGCAAGTGGGAGAAGTGGGCGCTCAGTTCAGC

AGCAGATTCCACGCCAAGACAGGCAGCCCTGGCATCAGATGTAGCGTCGTGACCAAAGAGAAGC

TGCAGGACAATCGGTTCTTCAAGAATCTGCAGAGAGAGGGCAGACTGACCCTGGACAAAATCGC

CGTGCTGAAAGAGGGCGATCTGTACCCAGACAAAGGCGGCGAGAAGTTCATCAGCCTGAGCAAG

GATCGGAAGTGCGTGACCACACACGCCGACATCAACGCCGCTCAGAACCTGCAGAAGCGGTTCT

GGACAAGAACCCACGGCTTCTACAAGGTGTACTGCAAGGCCTACCAGGTGGACggaggctctgg aggaagcTCCGAAGTCGAGTTTCCCATGAGTACTGGATGAGACACGCATTGACTCTCGCAAAG

AGGGCTCGAGATGAACGCGAGGTGCCCGTGGGGGCAGTACTCGTGCTCAACAATCGCGTAATCG

GCGAAGGTTGGAATAGGGCAATCGGACTCCACGACCCCACTGCACATGCGGAAATCATGGCCCT

TCGACAGGGAGGGCTTGTGATGCAGAATTATCGACTTTATGATGCGACGCTGTACGTCACGTTT

GAACCTTGCGTAATGTGCGCGGGAGCTATGATTCACTCCCGCATTGGACGAGTTGTATTCGGTG

TTCGCAACGCCAAGACGGGTGCCGCAGGTTCACTGATGGACGTGCTGCATCATCCAGGCATGAA

CCACCGGGTAGAAATCACAGAAGGCATATTGGCGGACGAATGTGCGGCGCTGTTGTGTCGTTTT

TTTCGCATGCCCAGGCGGGTCTTTAACGCCCAGAAAAAAGCACAATCCTCTACTGACGGCTCTT

CTGGATCTGAAACACCTGGCACAAGCGAGAGCGCCACCCCTGAGAGCTCTGGCGGCCAGACCGT

GTACATCCCTGAGAGCAAGGACCAGAAGCAGAAGATCATCGAAGAGTTCGGCGAGGGCTACTTC

ATTCTGAAGGACGGGGTGTACGAATGGGTCAACGCCGGCAAGCTGAAAATCAAGAAGGGCAGCT

CCAAGCAGAGCAGCAGCGAGCTGGTGGATAGCGACATCCTGAAAGACAGCTTCGACCTGGCCTC

CGAGCTGAAAGGCGAAAAGCTGATGCTGTACAGGGACCCCAGCGGCAATGTGTTCCCCAGCGAC

-continued

AAATGGATGGCCGCTGGCGTGTTCTTCGGAAAGCTGGAACGCATCCTGATCAGCAAGCTGACCA

ACCAGTACTCCATCAGCACCATCGAGGACGACAGCAGCAAGCAGTCTATG<u>AAAAGGCCGGCGGC</u>

<u>CACGAAAAAGGCCGGCCAGGCAAAAAAGAAAAAGGATCC</u>TACCCATACGATGTTCCAGATTAC

GCTTATCCCTACGACGTGCCTGATTATGCATACCCATATGATGTCCCCGACTATGCCTAA (SEQ ID NO: 281)

MAPKKKRKVGIHGVPAAATRSFILKIEPNEEVKKGLWKTHEVLNHGIAYYMNILKLIRQEAIYE

HHEQDPKNPKKVSKAEIQAELWDFVLKMQKCNSFTHEVDKDEVFNILRELYEELVPSSVEKKGE

ANQLSNKFLYPLVDPNSQSGKGTASSGRKPRWYNLKIAGDPSWEEEKKKWEEDKKKDPLAKILG

KLAEYGLIPLFIPYTDSNEPIVKEIKWMEKSRNQSVRRLDKDMFIQALERFLSWESWNLKVKEE

YEKVEKEYKTLEERIKEDIQALKALEQYEKERQEQLLRDTLNTNEYRLSKRGLRGWREIIQKWL

KMDENEPSEKYLEVFKDYQRKHPREAGDYSVYEFLSKKENHFIWRNHPEYPYLYATFCEIDKKK

KDAKQQATFTLADPINHPLWVRFEERSGSNLNKYRILTEQLHTEKLKKKLTVQLDRLIYPTESG

GWEEKGKVDIVLLPSRQFYNQIFLDIEEKGKHAFTYKDESIKFPLKGTLGGARVQFDRDHLRRY

PHKVESGNVGRIYFNMTVNIEPTESPVSKSLKIHRDDFPKVVNFKPKELTEWIKDSKGKKLKSG

IESLEIGLRVMSIDLGQRQAAAASIFEVVDQKPDIEGKLFFPIKGTELYAVHRASFNIKLPGET

LVKSREVLRKAREDNLKLMNQKLNFLRNVLHFQQFEDITEREKRVTKWISRQENSDVPLVYQDE

LIQIRELMYKPYKDWVAFLKQLHKRLEVEIGKEVKHWRKSLSDGRKGLYGISLKNIDEIDRTRK

FLLRWSLRPTEPGEVRRLEPGQRFAIDQLNHLNALKEDRLKKMANTIIMHALGYCYDVRKKKWQ

AKNPACQIILFEDLSNYNPYEERSRFENSKLMKWSRREIPRQVALQGEIYGLQVGEVGAQFSSR

FHAKTGSPGIRCSVVTKEKLQDNRFFKNLQREGRLTLDKIAVLKEGDLYPDKGGEKFISLSKDR

KCVTTHADINAAQNLQKRFWTRTHGFYKVYCKAYQVDGGSGGSSEVEFSHEYWMRHALTLAKRA

RDEREVPVGAVLVLNNRVIGEGWNRAIGLHDPTAHAEIMALRQGGLVMQNYRLYDATLYVTFEP

CVMCAGAMIHSRIGRVVFGVRNAKTGAAGSLMDVLHHPGMNHRVEITEGILADECAALLCRFFR

MPRRVFNAQKKAQSSTDGSSGSETPGTSESATPESSGGQTVYIPESKDQKQKIIEEFGEGYFIL

KDGVYEWVNAGKLKIKKGSSKQSSSELVDSDILKDSFDLASELKGEKLMLYRDPSGNVFPSDKW

MAAGVFFGKLERILISKLTNQYSISTIEDDSSKQSMKRPAATKKAGQAKKKKGSYPYDVPDYAY

PYDVPDYAYPYDVPDYA

BhCas12b GGSGGS-ABE8-Xten20 at K1019 ("GGSGGS" is disclosed as SEQ ID NO: 273)

(SEQ ID NO: 282)

<u>GCCACC</u>ATGGCCCCAAAGAAGAAGCGGAAGGTCGGTATCCACGGAGTCCCAGCAGCCGCCACCA

GATCCTTCATCCTGAAGATCGAGCCCAACGAGGAAGTGAAGAAAGGCCTCTGGAAAACCCACGA

GGTGCTGAACCACGGAATCGCCTACTACATGAATATCCTGAAGCTGATCCGGCAAGAGGCCATC

TACGAGCACCACGAGCAGGACCCCAAGAATCCCAAGAAGGTGTCCAAGGCCGAGATCCAGGCCG

AGCTGTGGGATTTCGTGCTGAAGATGCAGAAGTGCAACAGCTTCACACACGAGGTGGACAAGGA

CGAGGTGTTCAACATCCTGAGAGAGCTGTACGAGGAACTGGTGCCCAGCAGCGTGGAAAAGAAG

GGCGAAGCCAACCAGCTGAGCAACAAGTTTCTGTACCCTCTGGTGGACCCCAACAGCCAGTCTG

GAAAGGGAACAGCCAGCAGCGGCAGAAAGCCCAGATGGTACAACCTGAAGATTGCCGGCGATCC

CTCCTGGGAAGAAGAGAAGAAGAAGTGGGAAGAAGATAAGAAAAAGGACCCGCTGGCCAAGATC

CTGGGCAAGCTGGCTGAGTACGGACTGATCCCTCTGTTCATCCCCTACACCGACAGCAACGAGC

CCATCGTGAAAGAAATCAAGTGGATGGAAAAGTCCCGGAACCAGAGCGTGCGGCGGCTGGATAA

GGACATGTTCATTCAGGCCCTGGAACGGTTCCTGAGCTGGGAGAGCTGGAACCTGAAAGTGAAA

-continued

GAGGAATACGAGAAGGTCGAGAAAGAGTACAAGACCCTGGAAGAGAGGATCAAAGAGGACATCC

AGGCTCTGAAGGCTCTGGAACAGTATGAGAAAGAGCGGCAAGAACAGCTGCTGCGGGACACCCT

GAACACCAACGAGTACCGGCTGAGCAAGAGAGGCCTTAGAGGCTGGCGGGAAATCATCCAGAAA

TGGCTGAAAATGGACGAGAACGAGCCCTCCGAGAAGTACCTGGAAGTGTTCAAGGACTACCAGC

GGAAGCACCCTAGAGAGGCCGGCGATTACAGCGTGTACGAGTTCCTGTCCAAGAAAGAGAACCA

CTTCATCTGGCGGAATCACCCTGAGTACCCCTACCTGTACGCCACCTTCTGCGAGATCGACAAG

AAAAAGAAGGACGCCAAGCAGCAGGCCACCTTCACACTGGCCGATCCTATCAATCACCCTCTGT

GGGTCCGATTCGAGGAAAGAAGCGGCAGCAACCTGAACAAGTACAGAATCCTGACCGAGCAGCT

GCACACCGAGAAGCTGAAGAAAAAGCTGACAGTGCAGCTGGACCGGCTGATCTACCCTACAGAA

TCTGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGCAT

CAAGTTCCCTCTGAAGGGCACACTCGGCGGAGCCAGAGTGCAGTTCGACAGAGATCACCTGAGA

AGATACCCTCACAAGGTGGAAAGCGGCAACGTGGGCAGAATCTACTTCAACATGACCGTGAACA

TCGAGCCTACAGAGTCCCCAGTGTCCAAGTCTCTGAAGATCCACCGGGACGACTTCCCCAAGGT

GGTCAACTTCAAGCCCAAAGAACTGACCGAGTGGATCAAGGACAGCAAGGGCAAGAAACTGAAG

TCCGGCATCGAGTCCCTGGAAATCGGCCTGAGAGTGATGAGCATCGACCTGGGACAGAGACAGG

CCGCTGCCGCCTCTATTTTCGAGGTGGTGGATCAGAAGCCCGACATCGAAGGCAAGCTGTTTTT

CCCAATCAAGGGCACCGAGCTGTATGCCGTGCACAGAGCCAGCTTCAACATCAAGCTGCCCGGC

GAGACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAGAG

AGAGAAGCGGGTCACCAAGTGGATCAGCGAGACAAGAGAACAGCGACGTGCCCCTGGTGTACCAG

GATGAGCTGATCCAGATCCGCGAGCTGATGTACAAGCCTTACAAGGACTGGGTCGCCTTCCTGA

AGCAGCTCCACAAGAGACTGGAAGTCGAGATCGGCAAAGAAGTGAAGCACTGGCGGAAGTCCCT

GAGCGACGGAAGAAAGGGCCTGTACGGCATCTCCCTGAAGAACATCGACGAGATCGATCGGACC

CGGAAGTTCCTGCTGAGATGGTCCCTGAGGCCTACCGAACCTGGCGAAGTGCGTAGACTGGAAC

CCGGCCAGAGATTCGCCATCGACCAGCTGAATCACCTGAACGCCCTGAAAGAAGATCGGCTGAA

GAAGATGGCCAACACCATCATCATGCACGCCCTGGGCTACTGCTACGACGTGCGGAAGAAGAAA

TGGCAGGCTAAGAACCCCGCCTGCCAGATCATCCTGTTCGAGGATCTGAGCAACTACAACCCCT

ACGAGGAAAGGTCCCGCTTCGAGAACAGCAAGCTCATGAAGTGGTCCAGACGCGAGATCCCCAG

ACAGGTTGCACTGCAGGGCGAGATCTATGGCCTGCAAGTGGGAGAAGTGGGCGCTCAGTTCAGC

AGCAGATTCCACGCCAAGACAGGCAGCCCTGGCATCAGATGTAGCGTCGTGACCAAAGAGAAGC

TGCAGGACAATCGGTTCTTCAAGAATCTGCAGAGAGAGGGCAGACTGACCCTGGACAAAATCGC

CGTGCTGAAAGAGGGCGATCTGTACCCAGACAAAGGCGGCGAGAAGTTCATCAGCCTGAGCAAG

GATCGGAAGTGCGTGACCACACACGCCGACATCAACGCCGCTCAGAACCTGCAGAAGCGGTTCT

GGACAAGAACCCACGGCTTCTACAAGGTGTACTGCAAGGCCTACCAGGTGGACGGCCAGACCGT

GTACATCCCTGAGAGCAAGGACCAGAAGCAGAAGATCATCGAAGAGTTCGGCGAGGGCTACTTC

ATTCTGAAGGACGGGGTGTACGAATGGGTCAACGCCGGCAAGggaggctctggaggaagcTCCG

AAGTCGAGTTTTCCCATGAGTACTGGATGAGACACGCATTGACTCTCGCAAAGAGGGCTCGAGA

TGAACGCGAGGTGCCCGTGGGGGCAGTACTCGTGCTCAACAATCGCGTAATCGGCGAAGGTTGG

-continued

AATAGGGCAATCGGACTCCACGACCCACTGCACATGCGGAAATCATGGCCCTTCGACAGGGAG

GGCTTGTGATGCAGAATTATCGACTTTATGATGCGACGCTGTACGTCACGTTTGAACCTTGCGT

AATGTGCGCGGGAGCTATGATTCACTCCCGCATTGGACGAGTTGTATTCGGTGTTCGCAACGCC

AAGACGGGTGCCGCAGGTTCACTGATGGACGTGCTGCATCATCCAGGCATGAACCACCGGGTAG

AAATCACAGAAGGCATATTGGCGGACGAATGTGCGGCGCTGTTGTGTCGTTTTTTTCGCATGCC

CAGGCGGGTCTTTAACGCCCAGAAAAAAGCACAATCCTCTACTGACGGCTCTTCTGGATCTGAA

ACACCTGGCACAAGCGAGAGCGCCACCCCTGAGAGCTCTGGCCTGAAAATCAAGAAGGGCAGCT

CCAAGCAGAGCAGCAGCGAGCTGGTGGATAGCGACATCCTGAAAGACAGCTTCGACCTGGCCTC

CGAGCTGAAAGGCGAAAAGCTGATGCTGTACAGGGACCCCAGCGGCAATGTGTTCCCCAGCGAC

AAATGGATGGCCGCTGGCGTGTTCTTCGGAAAGCTGGAACGCATCCTGATCAGCAAGCTGACCA

ACCAGTACTCCATCAGCACCATCGAGGACGACAGCAGCAAGCAGTCTATGAAAAGGCCGGCGGC

CACGAAAAAGGCCGGCCAGGCAAAAAAGAAAAAGGGATCCTACCCATACGATGTTCCAGATTAC

GCTTATCCCTACGACGTGCCTGATTATGCATACCCATATGATGTCCCCGACTATGCCTAA (SEQ ID NO: 283)

MAPKKKRKVGIHGVPAAATRSFILKIEPNEEVKKGLWKTHEVLNHGIAYYMNILKLIRQEAIYE

HHEQDPKNPKKVSKAEIQAELWDFVLKMQKCNSFTHEVDKDEVFNILRELYEELVPSSVEKKGE

ANQLSNKFLYPLVDPNSQSGKGTASSGRKPRWYNLKIAGDPSWEEEKKKWEEDKKKDPLAKILG

KLAEYGLIPLFIPYTDSNEPIVKEIKWMEKSRNQSVRRLDKDMFIQALERFLSWESWNLKVKEE

YEKVEKEYKTLEERIKEDIQALKALEQYEKERQEQLLRDTLNTNEYRLSKRGLRGWREIIQKWL

KMDENEPSEKYLEVFKDYQRKHPREAGDYSVYEFLSKKENHFIWRNHPEYPYLYATFCEIDKKK

KDAKQQATFTLADPINHPLWVRFEERSGSNLNKYRILTEQLHTEKLKKKLTVQLDRLIYPTESG

GWEEKGKVDIVLLPSRQFYNQIFLDIEEKGKHAFTYKDESIKFPLKGTLGGARVQFDRDHLRRY

PHKVESGNVGRIYFNMTVNIEPTESPVSKSLKIHRDDFPKVVNFKPKELTEWIKDSKGKKLKSG

IESLEIGLRVMSIDLGQRQAAAASIFEVVDQKPDIEGKLFFPIKGTELYAVHRASFNIKLPGET

LVKSREVLRKAREDNLKLMNQKLNFLRNVLHFQQFEDITEREKRVTKWISRQENSDVPLVYQDE

LIQIRELMYKPYKDWVAFLKQLHKRLEVEIGKEVKHWRKSLSDGRKGLYGISLKNIDEIDRTRK

FLLRWSLRPTEPGEVRRLEPGQRFAIDQLNHLNALKEDRLKKMANTIIMHALGYCYDVRKKKWQ

AKNPACQIILFEDLSNYNPYEERSRFENSKLMKWSRREIPRQVALQGEIYGLQVGEVGAQFSSR

FHAKTGSPGIRCSVVTKEKLQDNRFFKNLQREGRLTLDKIAVLKEGDLYPDKGGEKFISLSKDR

KCVTTHADINAAQNLQKRFWTRTHGFYKVYCKAYQVDGQTVYIPESKDQKQKIIEEFGEGYFIL

KDGVYEWVNAGKGGSGGSSEVEFSHEYWMRHALTLAKRARDEREVPVGAVLVLNNRVIGEGWNR

AIGLHDPTAHAEIMALRQGGLVMQNYRLYDATLYVTFEPCVMCAGAMIHSRIGRVVFGVRNAKT

GAAGSLMDVLHHPGMNHRVEITEGILADECAALLCRFFRMPRRVFNAQKKAQSSTDGSSGSETP

GTSESATPESSGLKIKKGSSKQSSSELVDSDILKDSFDLASELKGEKLMLYRDPSGNVFPSDKW

MAAGVFFGKLERILISKLTNQYSISTIEDDSSKQSMKRPAATKKAGQAKKKKGSYPYDVPDYAY

PYDVPDYAYPYDVPDYA

For the sequences above, the Kozak sequence is bolded and underlined; marks the N-terminal nuclear localization signal (NLS); lower case characters denote the GGGSGGS linker (SEQ ID NO: 284); _ _ _ marks the sequence encoding ABE8, unmodified sequence encodes BhCas12b; double underling denotes the Xten20 linker; single underlining denotes the C-terminal NLS; GGATCC denotes the GS linker; and italicized characters represent the coding sequence of the 3× hemagglutinin (HA) tag.

In some embodiments, the nucleic acid programmable DNA binding protein (napDNAbp) of any of the fusion proteins provided herein may be a Cas12j/CasΦ protein. Cas12j/CasΦ is described in Pausch et al., "CRISPR-CasΦ from huge phages is a hypercompact genome editor," *Sci-ence,* 17 Jul. 2020, Vol. 369, Issue 6501, pp. 333-337, which is incorporated herein by reference in its entirety. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12j/CasΦ protein. In some embodiments, the napDNAbp is a naturally-occurring Cas12j/CasΦ protein. In some embodiments, the napDNAbp is a nuclease inactive ("dead") Cas12j/CasΦ protein. It should be appreciated that Cas12j/CasΦ from other species may also be used in accordance with the present disclosure.

Exemplary Cas12j/CasΦ amino acid sequences follow:

```
>CasΦ-1
MADTPTLFTQFLRHHLPGQRFRKDILKQAGRILANKGEDATIAFLRGKSEESPPDFQPP

VKCPIIACSRPLTEWPIYQASVAIQGYVYGQSLAEFEASDPGCSKDGLLGWFDKTGVCTDYFSV

QGLNLIFQNARKRYIGVQTKVTNRNEKRHKKLKRINAKRIAEGLPELTSDEPESALDETGHLID

PPGLNTNIYCYQQVSPKPLALSEVNQLPTAYAGYSTSGDDPIQPMVTKDRLSISKGQPGYIPEH

QRALLSQKKHRRMRGYGLKARALLVIVRIQDDWAVIDLRSLLRNAYWRRIVQTKEPSTITKLLK

LVTGDPVLDATRMVATFTYKPGIVQVRSAKCLKNKQGSKLFSERYLNETVSVTSIDLGSNNLVA

VATYRLVNGNTPELLQRFTLPSHLVKDFERYKQAHDTLEDSIQKTAVASLPQGQQTEIRMWSMY

GFREAQERVCQELGLADGSIPWNVMTATSTILTDLFLARGGDPKKCMFTSEPKKKKNSKQVLYK

IRDRAWAKMYRTLLSKETREAWNKALWGLKRGSPDYARLSKRKEELARRCVNYTISTAEKRAQC

GRTIVALEDLNIGFFHGRGKQEPGWVGLFTRKKENRWLMQALHKAFLELAHHRGYHVIEVNPAY

TSQTCPVCRHCDPDNRDQHNREAFHCIGCGFRGNADLDVATHNIAMVAITGESLKRARGSVASK

TPQPLAAE*

>CasΦ-2
MPKPAVESEFSKVLKKHFPGERFRSSYMKRGGKILAAQGEEAVVAYLQGKSEEEPPNFQPPAKC

HVVTKSRDFAEWPIMKASEAIQRYTYALSTTERAACKPGKSSESHAAWFAATGVSNHGYSHVOG

LNLIFDHTLGRYDGVLKKVQLRNEKARARLESINASRADEGLPEIKAEEEEVATNETGHLLQPP

GINPSFYVYQTISPQAYRPRDEIVLPPEYAGYVRDPNAPIPLGVVRNRCDIQKGCPGYIPEWQR

EAGTAISPKTGKAVTVPGLSPKKNKRMRRYWRSEKEKAQDALLVTVRIGTDWVVIDVRGLLRNA

RWRTIAPKDISLNALLDLFTGDPVIDVRRNIVTFTYTLDACGTYARKWTLKGKQTKATLDKLTA

TQTVALVAIDLGQTNPISAGISRVTQENGALQCEPLDRFTLPDDLLKDISAYRIAWDRNEEELR

ARSVEALPEAQQAEVRALDGVSKETARTQLCADFGLDPKRLPWDKMSSNTTFISEALLSNSVSR

DQVFETPAPKKGAKKKAPVEVMRKDRTWARAYKPRLSVEAQKLKNEALWALKRTSPEYLKLSRR

KEELCRRSINYVIEKTRRRTQCQIVIPVIEDLNVRFFHGSGKRLPGWDNFFTAKKENRWFTOGL

HKAFSDLRTHRSFYVFEVRPERTSITCPKCGHCEVGNRDGEAFQCLSCGKTCNADLDVATHNLT

QVALTGKTMPKREEPRDAQGTAPARKTKKASKSKAPPAEREDQTPAQEPSQTS

>CasΦ-3
MEKEITELTKIRREFPNKKFSSTDMKKAGKLLKAEGPDAVRDFLNSCQEIIGDFKPPVKTNIVS

ISRPFEEWPVSMVGRAIQEYYFSLTKEELESVHPGTSSEDHKSFFNITGLSNYNYTSVQGLNLI

FKNAKAIYDGTLVKANNKNKKLEKKFNEINHKRSLEGLPIITPDFEEPFDENGHLNNPPGINRN

IYGYQGCAAKVFVPSKHKMVSLPKEYEGYNRDPNLSLAGFRNRLEIPEGEPGHVPWFQRMDIPE

GQIGHVNKIQRFNFVHGKNSGKVKFSDKTGRVKRYHHSKYKDATKPYKFLEESKKVSALDSILA

IITIGDDWVVFDIRGLYRNVFYRELAQKGLTAVQLLDLFTGDPVIDPKKGVVTFSYKEGVVPVF
```

-continued

SQKIVPRFKSRDTLEKLTSQGPVALLSVDLGQNEPVAARVCSLKNINDKITLDNSCRISFLDDY

KKQIKDYRDSLDELEIKIRLEAINSLETNQQVEIRDLDVFSADRAKANTVDMFDIDPNLISWDS

MSDARVSTQISDLYLKNGGDESRVYFEINNKRIKRSDYNISQLVRPKLSDSTRKNLNDSIWKLK

RTSEEYLKLSKRKLELSRAVVNYTIRQSKLLSGINDIVIILEDLDVKKKFNGRGIRDIGWDNFE

SSRKENRWFIPAFHKAFSELSSNRGLCVIEVNPAWTSATCPDCGFCSKENRDGINFTCRKCGVS

YHADIDVATLNIARVAVLGKPMSGPADRERLGDTKKPRVARSRKTMKRKDISNSTVEAMVTA*

>CasΦ-4
MYSLEMADLKSEPSLLAKLLRDRFPGKYWLPKYWKLAEKKRLTGGEEAACEYMADKQLDSPPPN

FRPPARCVILAKSRPFEDWPVHRVASKAQSPPIGLSEQGFAALRAAPPSTADARRDWLRSEGAS

EDDLMALEAQLLETIMGNAISLHGGVLKKIDNANVKAAKRLSGRNEARLNKGLQELPPEQEGSA

YGADGLLVNPPGLNLNIYCRKSCCPKPVKNTARFVGHYPGYLRDSDSILISGTMDRLTIIEGMP

GHIPAWQREQGLVKPGGRRRRLSGSESNMRQKVDPSTGPRRSTRSGTVNRSNQRTGRNGDPLLV

EIRMKEDWVLLDARGLLRNLRWRESKRGLSCDHEDLSLSGLLALFSGDPVIDPVRNEVVFLYGE

GIIPVRSTKPVGTRQSKKLLERQASMGPLTLISCDLGQTNLIAGRASAISLTHGSLGVRSSVRI

ELDPEIIKSFERLRKDADRLETEILTAAKETLSDEQRGEVNSHEKDSPQTAKASLCRELGLHPP

SLPWGQMGPSTTFIADMLISHGRDDDAFLSHGEFPTLEKRKKFDKRFCLESRPLLSSETRKALN

ESLWEVKRTSSEYARLSQRKKEMARRAVNFVVEISRRKTGLSNVIVNIEDLNVRIFHGGGKQAP

GWDGFFRPKSENRWFIQAIHKAFSDLAAHHGIPVIESDPQRTSMTCPECGHCDSKNRNGVRFLC

KGCGASMDADFDAACRNLERVALTGKPMPKPSTSCERLLSATTGKVCSDHSLSHDAIEKAS*

>CasΦ-5
MSSLPTPLELLKQKHADLFKGLQFSSKDNKMAGKVLKKDGEEAALAFLSERGVSRGELPNFRPP

AKTLVVAQSRPFEEFPIYRVSEAIQLYVYSLSVKELETVPSGSSTKKEHQRFFQDSSVPDFGYT

SVQGLNKIFGLARGIYLGVITRGENQLQKAKSKHEALNKKRRASGEAETEFDPTPYEYMTPERK

LAKPPGVNHSIMCYVDISVDEFDFRNPDGIVLPSEYAGYCREINTAIEKGTVDRLGHLKGGPGY

IPGHQRKESTTEGPKINFRKGRIRRSYTALYAKRDSRRVRQGKLALPSYRHHMMRLNSNAESAI

LAVIFFGKDWVVFDLRGLLRNVRWRNLFVDGSTPSTLLGMFGDPVIDPKRGVVAFCYKEQIVPV

VSKSITKMVKAPELLNKLYLKSEDPLVLVAIDLGQTNPVGVGVYRVMNASLDYEVVTRFALESE

LLREIESYRQRTNAFEAQIRAETFDAMTSEEQEEITRVRAFSASKAKENVCHRFGMPVDAVDWA

TMGSNTIHIAKWVMRHGDPSLVEVLEYRKDNEIKLDKNGVPKKVKLTDKRIANLTSIRLRFSQE

TSKHYNDTMWELRRKHPVYQKLSKSKADFSRRVVNSIIRRVNHLVPRARIVFIIEDLKNLGKVE

HGSGKRELGWDSYFEPKSENRWFIQVLHKAFSETGKHKGYYIIECWPNWTSCTCPKCSCCDSEN

RHGEVFRCLACGYCNTDFGAPDNLVKLAGKGLPGPKKRCKGSSKGKNPKLARSSETGVSV

TESGAPKVKKSSPTQTSQSSSQSAP*

>CasΦ-6
MNKIEKEKTPLAKLMNENFAGLRFPFAIIKQAGKKLLKEGELKTIEYMTGKGSIEPLPNFKPPV

KCLIVAKRRDLKYFPICKASCEIQSYVYSLNYKDEMDYFSTPMTSQKQHEEFFKKSGLNIEYQN

VAGLNLIFNNVKNTYNGVILKVKNRNEKLKKKAIKNNYEFEEIKTFNDDGCLINKPGINNVIYC

FQSISPKILKNITHLPKEYNDYDCSVDRNIIQKYVSRLDIPESQPGHVPEWQRKLPEFNNTNNP

RRRRKWYSNGRNISKGYSVDQVNQAKIEDSLLAQIKIGEDWIILDIRGLLRDLNRRELISYKNK

LTIKDVLGFFSDYPIIDIKKNLVTFCYKEGVIQVVSQKSIGNKKSKQLLEKLIENKPIALVSID

LGQTNPVSVKISKLNKINNKISIESFTYRFLNEEILKEIEKYRKDYDKLELKLINEA

-continued

>CasΦ-7
MSNTAVSTREHMSNKTTPPSPLSLLLRAHFPGLKFESQDYKIAGKKLRDGGPEAVISYLTGKGQ

AKLKDVKPPAKAFVIAQSRPFIEWDLVRVSRQIQEKIFGIPATKGRPKQDGLSETAFNEAVASL

EVDGKSKLNEETRAAFYEVLGLDAPSLHAQAQNALIKSAISIREGVLKKVENRNEKNLSKTKRR

KEAGEEATFVEEKAHDERGYLIHPPGVNQTIPGYQAVVIKSCPSDFIGLPSGCLAKESAEALTD

YLPHDRMTIPKGQPGYVPEWQHPLLNRRKNRRRRDWYSASLNKPKATCSKRSGTPNRKNSRTDQ

IQSGRFKGAIPVLMRFQDEWVIIDIRGLLRNARYRKLLKEKSTIPDLLSLFTGDPSIDMRQGVC

TFIYKAGQACSAKMVKTKNAPEILSELTKSGPVVLVSIDLGQTNPIAAKVSRVTQLSDGQLSHE

TLLRELLSNDSSDGKEIARYRVASDRLRDKLANLAVERLSPEHKSEILRAKNDTPALCKARVCA

ALGLNPEMIAWDKMTPYTEFLATAYLEKGGDRKVATLKPKNRPEMLRRDIKFKGTEGVRIEVSP

EAAEAYREAQWDLQRTSPEYLRLSTWKQELTKRILNQLRHKAAKSSQCEVVVMAFEDLNIKMMH

GNGKWADGGWDAFFIKKRENRWFMQAFHKSLTELGAHKGVPTIEVTPHRTSITCTKCGHCDKAN

RDGERFACQKCGFVAHADLEIATDNIERVALTGKPMPKPESERSGDAKKSVGARKAAFKPEEDA

EAAE*

>CasΦ-8
MTKPTVSQFLTPGFKLIRNHSRTAGLKLKNEGEEACKKFVRENEIPKDECPNFQGGPAIANIIA

KSREFTEWEIYQSSLAIQEVIFTLPKDKLPEPILKEEWRAQWLSEHGLDTVPYKEAAGLNLIIK

NAVNTYKGVQVKVDNKNKNNLAKINRKNEIAKLNGEQEISFEEIKAFDDKGYLLQKPSPNKSIY

CYQSVSPKPFITSKYHNVNLPEEYIGYYRKSNEPIVSPYQFDRLRIPIGEPGYVPKWQYTFLSK

KENKRRKLSKRIKNVSPILGIICIKKDWCVFDMRGLLRTNHWKKYHKPTDSINDLFDYFTGDPV

IDTKANVVRFRYKMENGIVNYKPVREKKGKELLENICDQNGSCKLATVDVGQNNPVAIGLFELK

KVNGELTKTLISRHPTPIDFCNKITAYRERYDKLESSIKLDAIKQLTSEQKIEVDNYNNNFTPQ

NTKQIVCSKLNINPNDLPWDKMISGTHFISEKAQVSNKSEIYETSTDKGKTKDVMKSDYKWFQD

YKPKLSKEVRDALSDIEWRLRRESLEFNKLSKSREQDARQLANWISSMCDVIGIENLVKKNNFE

GGSGKREPGWDNFYKPKKENRWWINAIHKALTELSQNKGKRVILLPAMRTSITCPKCKYCDSKN

RNGEKFNCLKCGIELNADIDVATENLATVAITAQSMPKPTCERSGDAKKPVRARKAKAPEFHDK

LAPSYTVVLREAV*

>CasΦ-9
MRSSREIGDKILMRQPAEKTAFQVFRQEVIGTQKLSGGDAKTAGRLYKQGKMEAAREWLLKGAR

DDVPPNFQPPAKCLVVAVSHPFEEWDISKTNHDVQAYIYAQPLQAEGHLNGLSEKWEDTSADQH

KLWFEKTGVPDRGLPVQAINKIAKAAVNRAFGVVRKVENRNEKRRSRDNRIAEHNRENGLTEVV

REAPEVATNADGFLLHPPGIDPSILSYASVSPVPYNSSKHSFVRLPEEYQAYNVEPDAPIPQEV

VEDRFAIPPGQPGYVPEWQRLKCSTNKHRRMRQWSNQDYKPKAGRRAKPLEFQAHLTRERAKGA

LLVVMRIKEDWVVFDVRGLLRNVEWRKVLSEEAREKLTLKGLLDLETGDPVIDTKRGIVTFLYK

AEITKILSKRTVKTKNARDLLLRLTEPGEDGLRREVGLVAVDLGQTHPIAAAIYRIGRTSAGAL

ESTVLHRQGLREDQKEKLKEYRKRHTALDSRLRKEAFETLSVEQQKEIVTVSGSGAQITKDKVC

NYLGVDPSTLPWEKMGSYTHFISDDFLRRGGDPNIVHFDRQPKKGKVSKKSQRIKRSDSQWVGR

MRPRLSQETAKARMEADWAAQNENEEYKRLARSKQELARWCVNTLLQNTRCITQCDEIVVVIED

LNVKSLHGKGAREPGWDNFFTPKTENRWFIQILHKTFSELPKHRGEHVIEGCPLRTSITCPACS

YCDKNSRNGEKFVCVACGATFHADFEVATYNLVRLATTGMPMPKSLERQGGGEKAGGARKARKK

AKQVEKIVVQANANVTMNGASLHSP*

-continued

```
>CasΦ-10
MDMLDTETNYATETPAQQQDYSPKPPKKAQRAPKGFSKKARPEKKPPKPITLFTQKHFSGVRFL

KRVIRDASKILKLSESRTITFLEQAIERDGSAPPDVTPPVHNTIMAVTRPFEEWPEVILSKALQ

KHCYALTKKIKIKTWPKKGPGKKCLAAWSARTKIPLIPGQVQATNGLFDRIGSIYDGVEKKVTN

RNANKKLEYDEATKEGRNPAVPEYETAYNIDGTLINKPGYNPNLYITQSRTPRLITEADRPLVE

KILWQMVEKKTQSRNQARRARLEKAAHLQGLPVPKFVPEKVDRSQKIEIRTIDPLDKIEPYMPQ

DRMAIKASQDGHVPYWQRPFLSKRRNRRVRAGWGKQVSSIQAWLTGALLVIVRLGNEAFLADIR

GALRNAQWRKLLKPDATYQSLFNLFTGDPVVNTRTNHLTMAYREGVVNIVKSRSFKGRQTREHL

LTLLGQGKTVAGVSFDLGQKHAAGLLAAHFGLGEDGNPVFTPIQACELPQRYLDSLTNYRNRYD

ALTLDMRRQSLLALTPAQQQEFADAQRDPGGQAKRACCLKLNLNPDEIRWDLVSGISTMISDLY

IERGGDPRDVHQQVETKPKGKRKSEIRILKIRDGKWAYDFRPKIADETRKAQREQLWKLQKASS

EFERLSRYKINIARAIANWALQWGRELSGCDIVIPVLEDLNVGSKFFDGKGKWLLGWDNRFTPK

KENRWFIKVLHKAVAELAPHRGVPVYEVMPHRTSMTCPACHYCHPTNREGDRFECQSCHVVKNT

DRDVAPYNILRVAVEGKTLDRWQAEKKPQAEPDRPMILIDNQES*
```
The asterisk (*) in the sequences above denotes a STOP codon.
Alternatively, CasΦ-1 is also termed Casl2j ortholog 1. Tims,
CasΦ-1- CasΦ-10 may also be referred to as Casl2j
orthologs 1-10, respectively.

Guide Polynucleotides

In an embodiment, the guide polynucleotide is a guide RNA. As used herein, the term "guide RNA (gRNA)" and its grammatical equivalents can refer to an RNA which can be specific for a target DNA and can form a complex with Cas protein. An RNA/Cas complex can assist in "guiding" Cas protein to a target DNA. Cas9/crRNA/tracrRNA endonucle-olytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA," or simply "gRNA") can be engineered so as to incorporate aspects of both the crRNA and tracrRNA into a single RNA species. See, e.g., Jinek M. et al., Science 337:816-821(2012), the entire contents of which is hereby incorporated by reference. Cas9 recognizes a short motif in the CRISPR repeat sequences (the PAM or proto-spacer adjacent motif) to help distinguish self versus non-self. Cas9 nuclease sequences and structures are well known to those of skill in the art (see e.g., "Complete genome sequence of an M1 strain of *Streptococcus pyogenes*." Ferretti, J. J. et al., Natl. Acad. Sci. U.S.A. 98:4658-4663 (2001); "CRISPR RNA maturation by trans-encoded small RNA and host factor RNase III." Deltcheva E. et al., Nature 471:602-607(2011); and "Programmable dual-RNA-guided DNA endonuclease in adaptive bacterial immunity." Jinek M. et al, Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences can be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

In some embodiments, the guide polynucleotide is at least one single guide RNA ("sgRNA" or "gRNA"). In some embodiments, the guide polynucleotide is at least one tracrRNA. In some embodiments, the guide polynucleotide does not require PAM sequence to guide the polynucleotide-programmable DNA-binding domain (e.g., Cas9 or Cpf1) to the target nucleotide sequence.

The polynucleotide programmable nucleotide binding domain (e.g., a CRISPR-derived domain) of the base editors disclosed herein can recognize a target polynucleotide sequence by associating with a guide polynucleotide. A guide polynucleotide (e.g., gRNA) is typically single-stranded and can be programmed to site-specifically bind (i.e., via complementary base pairing) to a target sequence of a polynucleotide, thereby directing a base editor that is in conjunction with the guide nucleic acid to the target sequence. A guide polynucleotide can be DNA. A guide polynucleotide can be RNA. As will be appreciated by one having skill in the art, in a guide polynucleotide sequence uracil (U) replaces thymine (T) in the sequence. In some embodiments, the guide polynucleotide comprises natural nucleotides (e.g., adenosine). In some embodiments, the guide polynucleotide comprises non-natural (or unnatural) nucleotides (e.g., peptide nucleic acid or nucleotide analogs). In some embodiments, the targeting region of a guide nucleic acid sequence can be at least 15, 16, 17, 18, 19, 20, 21, 22, 23, 24, 25, 26, 27, 28, 29, or 30 nucleotides in length. A targeting region of a guide nucleic acid can be between 10-30 nucleotides in length, or between 15-25 nucleotides in length, or between 15-20 nucleotides in length. In some embodiments, a guide polynucleotide may be truncated by 1, 2, 3, 4, etc. nucleotides, particularly at the 5' end. By way of nonlimiting example, a guide polynucleotide of 20 nucleotides in length may be truncated by 1, 2, 3, 4, etc. nucleotides, particularly at the 5' end.

In some embodiments, a guide polynucleotide comprises two or more individual polynucleotides, which can interact with one another via for example complementary base pairing (e.g., a dual guide polynucleotide). For example, a guide polynucleotide can comprise a CRISPR RNA (crRNA) and a trans-activating CRISPR RNA (tracrRNA). For example, a guide polynucleotide can comprise one or more trans-activating CRISPR RNA (tracrRNA).

In type II CRISPR systems, targeting of a nucleic acid by a CRISPR protein (e.g., Cas9) typically requires complementary base pairing between a first RNA molecule (crRNA) comprising a sequence that recognizes the target sequence and a second RNA molecule (trRNA) comprising repeat sequences which forms a scaffold region that stabilizes the guide RNA-CRISPR protein complex. Such dual guide RNA systems can be employed as a guide polynucleotide to direct the base editors disclosed herein to a target polynucleotide sequence.

In some embodiments, the base editor provided herein utilizes a single guide polynucleotide (e.g., sgRNA). In some embodiments, the base editor provided herein utilizes a dual guide polynucleotide (e.g., dual gRNAs). In some embodiments, the base editor provided herein utilizes one or more guide polynucleotide (e.g., multiple gRNA). In some embodiments, a single guide polynucleotide is utilized for different base editors described herein. For example, a single guide polynucleotide can be utilized for a cytidine base editor and an adenosine base editor.

In other embodiments, a guide polynucleotide can comprise both the polynucleotide targeting portion of the nucleic acid and the scaffold portion of the nucleic acid in a single molecule (i.e., a single-molecule guide nucleic acid). For example, a single-molecule guide polynucleotide can be a single guide RNA (sgRNA or gRNA). Herein the term guide polynucleotide sequence contemplates any single, dual or multi-molecule nucleic acid capable of interacting with and directing a base editor to a target polynucleotide sequence.

Typically, a guide polynucleotide (e.g., crRNA/trRNA complex or a gRNA) comprises a "polynucleotide-targeting segment" that includes a sequence capable of recognizing and binding to a target polynucleotide sequence, and a "protein-binding segment" that stabilizes the guide polynucleotide within a polynucleotide programmable nucleotide binding domain component of a base editor. In some embodiments, the polynucleotide targeting segment of the guide polynucleotide recognizes and binds to a DNA polynucleotide, thereby facilitating the editing of a base in DNA. In other embodiments, the polynucleotide targeting segment of the guide polynucleotide recognizes and binds to an RNA polynucleotide, thereby facilitating the editing of a base in RNA. Herein a "segment" refers to a section or region of a molecule, e.g., a contiguous stretch of nucleotides in the guide polynucleotide. A segment can also refer to a region/ section of a complex such that a segment can comprise regions of more than one molecule. For example, where a guide polynucleotide comprises multiple nucleic acid molecules, the protein-binding segment of can include all or a portion of multiple separate molecules that are for instance hybridized along a region of complementarity. In some embodiments, a protein-binding segment of a DNA-targeting RNA that comprises two separate molecules can comprise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and can include regions of RNA molecules that are of any total length and can include regions with complementarity to other molecules.

A guide RNA or a guide polynucleotide can comprise two or more RNAs, e.g., CRISPR RNA (crRNA) and transactivating crRNA (tracrRNA). A guide RNA or a guide polynucleotide can sometimes comprise a single-chain RNA, or single guide RNA (sgRNA) formed by fusion of a portion (e.g., a functional portion) of crRNA and tracrRNA. A guide RNA or a guide polynucleotide can also be a dual RNA comprising a crRNA and a tracrRNA. Furthermore, a crRNA can hybridize with a target DNA.

As discussed above, a guide RNA or a guide polynucleotide can be an expression product. For example, a DNA that encodes a guide RNA can be a vector comprising a sequence coding for the guide RNA. A guide RNA or a guide polynucleotide can be transferred into a cell by transfecting the cell with an isolated guide RNA or plasmid DNA comprising a sequence coding for the guide RNA and a promoter. A guide RNA or a guide polynucleotide can also be transferred into a cell in other way, such as using virus-mediated gene delivery.

A guide RNA or a guide polynucleotide can be isolated. For example, a guide RNA can be transfected in the form of an isolated RNA into a cell or organism. A guide RNA can be prepared by in vitro transcription using any in vitro transcription system known in the art. A guide RNA can be transferred to a cell in the form of isolated RNA rather than in the form of plasmid comprising encoding sequence for a guide RNA.

A guide RNA or a guide polynucleotide can comprise three regions: a first region at the 5' end that can be complementary to a target site in a chromosomal sequence, a second internal region that can form a stem loop structure, and a third 3' region that can be single-stranded. A first region of each guide RNA can also be different such that each guide RNA guides a fusion protein to a specific target site. Further, second and third regions of each guide RNA can be identical in all guide RNAs.

A first region of a guide RNA or a guide polynucleotide can be complementary to sequence at a target site in a chromosomal sequence such that the first region of the guide RNA can base pair with the target site. In some embodiments, a first region of a guide RNA can comprise from or from about 10 nucleotides to 25 nucleotides (i.e., from 10 nucleotides to nucleotides; or from about 10 nucleotides to about 25 nucleotides; or from 10 nucleotides to about 25 nucleotides; or from about 10 nucleotides to 25 nucleotides) or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more nucleotides in length. In some embodiments, a first region of a guide RNA can be or can be about 19, 20, or 21 nucleotides in length.

A guide RNA or a guide polynucleotide can also comprise a second region that forms a secondary structure. For example, a secondary structure formed by a guide RNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A guide RNA or a guide polynucleotide can also comprise a third region at the 3' end that can be essentially single-stranded. For example, a third region is sometimes not complementarity to any chromosomal sequence in a cell of interest and is sometimes not complementarity to the rest of a guide RNA. Further, the length of a third region can vary. A third region can be more than or more than about 4 nucleotides in length. For example, the length of a third region can range from or from about 5 to 60 nucleotides in length.

A guide RNA or a guide polynucleotide can target any exon or intron of a gene target. In some embodiments, a guide can target exon 1 or 2 of a gene; in other embodiments, a guide can target exon 3 or 4 of a gene. A composition can comprise multiple guide RNAs that all target the same exon or in some embodiments, multiple guide RNAs that can target different exons. A$_n$ exon and an intron of a gene can be targeted.

A guide RNA or a guide polynucleotide can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30, or anywhere between 1-100 nucleotides in length. A target nucleic acid can be at most or at most about 5, 10, 15, 16, 17, 18, 19, 20, 21, 22, 23, 24, 25, 30, 40, 50, or anywhere between 1-100 nucleotides in length. A target nucleic acid sequence can be or can be about 20 bases immediately 5' of the first nucleotide of the PAM. A guide RNA can target a nucleic acid sequence. A target nucleic acid can be at least or at least about 1-10, 1-20, 1-30, 1-40, 1-50, 1-60, 1-70, 1-80, 1-90, or 1-100 nucleotides.

A guide polynucleotide, for example, a guide RNA, can refer to a nucleic acid that can hybridize to another nucleic acid, for example, the target nucleic acid or protospacer in a genome of a cell. A guide polynucleotide can be RNA. A guide polynucleotide can be DNA. The guide polynucleotide can be programmed or designed to bind to a sequence of nucleic acid site-specifically. A guide polynucleotide can comprise a polynucleotide chain and can be called a single guide polynucleotide. A guide polynucleotide can comprise two polynucleotide chains and can be called a double guide polynucleotide. A guide RNA can be introduced into a cell or embryo as an RNA molecule. For example, an RNA molecule can be transcribed in vitro and/or can be chemically synthesized. An RNA can be transcribed from a synthetic DNA molecule, e.g., a gBlocks® gene fragment. A guide RNA can then be introduced into a cell or embryo as an RNA molecule. A guide RNA can also be introduced into a cell or embryo in the form of a non-RNA nucleic acid molecule, e.g., a DNA molecule. For example, a DNA encoding a guide RNA can be operably linked to promoter control sequence for expression of the guide RNA in a cell or embryo of interest. An RNA coding sequence can be operably linked to a promoter sequence that is recognized by RNA polymerase III (Pol III). Plasmid vectors that can be used to express guide RNA include, but are not limited to, px330 vectors and px333 vectors. In some embodiments, a plasmid vector (e.g., px333 vector) can comprise at least two guide RNA-encoding DNA sequences.

Methods for selecting, designing, and validating guide polynucleotides, e.g., guide RNAs and targeting sequences are described herein and known to those skilled in the art. For example, to minimize the impact of potential substrate promiscuity of a deaminase domain in the nucleobase editor system (e.g., an AID domain), the number of residues that could unintentionally be targeted for deamination (e.g., off-target C residues that could potentially reside on ssDNA within the target nucleic acid locus) may be minimized. In addition, software tools can be used to optimize the gRNAs corresponding to a target nucleic acid sequence, e.g., to minimize total off-target activity across the genome. For example, for each possible targeting domain choice using S. pyogenes Cas9, all off-target sequences (preceding selected PAMs, e.g., NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g., crRNAs) can be ranked according to its total predicted off-target score; the top-ranked targeting domains represent those that are likely to have the greatest on-target and the least off-target activity. Candidate targeting gRNAs can be functionally evaluated by using methods known in the art and/or as set forth herein.

As a non-limiting example, target DNA hybridizing sequences in crRNAs of a guide RNA for use with Cas9s may be identified using a DNA sequence searching algorithm. gRNA design may be carried out using custom gRNA design software based on the public tool cas-offinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014). This software scores guides after calculating their genome-wide off-target propensity. Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a target nucleic acid sequence, e.g., a target gene may be obtained and repeat elements may be screened using publicly available tools, for example, the RepeatMasker program. RepeatMasker searches input DNA sequences for repeated elements and regions of low complexity. The output is a detailed annotation of the repeats present in a given query sequence.

Following identification, first regions of guide RNAs, e.g., crRNAs, may be ranked into tiers based on their distance to the target site, their orthogonality and presence of 5' nucleotides for close matches with relevant PAM sequences (for example, a 5' G based on identification of close matches in the human genome containing a relevant PAM e.g., NGG PAM for S. pyogenes, NNGRRT or NNGRRV PAM for S. aureus). As used herein, orthogonality refers to the number of sequences in the human genome that contain a minimum number of mismatches to the target sequence. A "high level of orthogonality" or "good orthogonality" may, for example, refer to 20-mer targeting domains that have no identical sequences in the human genome besides the intended target, nor any sequences that contain one or two mismatches in the target sequence. Targeting domains with good orthogonality may be selected to minimize off-target DNA cleavage.

In some embodiments, a reporter system may be used for detecting base-editing activity and testing candidate guide polynucleotides. In some embodiments, a reporter system may comprise a reporter gene based assay where base editing activity leads to expression of the reporter gene. For example, a reporter system may include a reporter gene comprising a deactivated start codon, e.g., a mutation on the template strand from 3'-TAC-5' to 3'-CAC-5'. Upon successful deamination of the target C, the corresponding mRNA will be transcribed as 5'-AUG-3' instead of 5'-GUG-3', enabling the translation of the reporter gene. Suitable reporter genes will be apparent to those of skill in the art. Non-limiting examples of reporter genes include gene encoding green fluorescence protein (GFP), red fluorescence protein (RFP), luciferase, secreted alkaline phosphatase (SEAP), or any other gene whose expression are detectable and apparent to those skilled in the art. The reporter system can be used to test many different gRNAs, e.g., in order to determine which nucleotide residue(s) with respect to the target DNA sequence the respective deaminase will target. sgRNAs that target non-template strand nucleotide residues can also be tested in order to assess off-target effects of a specific base editing protein, e.g., a Cas9 deaminase fusion protein. In some embodiments, such gRNAs can be designed such that the mutated start codon will not be base-paired with the gRNA. The guide polynucleotides can comprise standard nucleotides, modified nucleotides (e.g., pseudouridine), nucleotide isomers, and/or nucleotide analogs. In some embodiments, the guide polynucleotide can comprise at least one detectable label. The detectable label can be a fluorophore (e.g., FAM, TMR, Cy3, Cy5, Texas Red, Oregon Green, Alexa Fluors, Halo tags, or any other suitable fluorescent dye), a detection tag (e.g., biotin, digoxigenin, and the like), quantum dots, or gold particles.

The guide polynucleotides can be synthesized chemically and/or enzymatically. For example, the guide RNA can be synthesized using standard phosphoramidite-based solid-phase synthesis methods. Alternatively, the guide RNA can be synthesized in vitro by operably linking DNA encoding the guide RNA to a promoter control sequence that is recognized by a phage RNA polymerase. Examples of suitable phage promoter sequences include T7, T3, SP6 promoter sequences, or variations thereof. In embodiments in which the guide RNA comprises two separate molecules (e.g., crRNA and tracrRNA), the crRNA can be chemically synthesized and the tracrRNA can be enzymatically synthesized.

In some embodiments, a base editor system may comprise multiple guide polynucleotides, e.g., gRNAs. For example, the gRNAs may target the base editor to one or more target loci (e.g., at least one (1) gRNA, at least 2 gRNA, at least 5 gRNA, at least 10 gRNA, at least 20 gRNA, at least 30 g RNA, or at least 50 gRNA). In some embodiments, multiple gRNA sequences can be tandemly arranged and are preferably separated by a direct repeat.

A DNA sequence encoding a guide RNA or a guide polynucleotide can also be part of a vector. In some embodiments, a vector comprises additional expression control sequences (e.g., enhancer sequences, Kozak sequences, polyadenylation sequences, transcriptional termination sequences, etc.), selectable marker sequences (e.g., GFP or antibiotic resistance genes such as puromycin), origins of replication, and the like. A DNA molecule encoding a guide RNA or a guide polynucleotide can be circular or linear.

In some embodiments, one or more components of a base editor system may be encoded by DNA sequences. Such DNA sequences may be introduced into an expression system, e.g., a cell, together or separately. For example, DNA sequences encoding a polynucleotide programmable nucleotide binding domain and a guide RNA may be introduced into a cell, each DNA sequence can be part of a separate molecule (e.g., one vector containing the polynucleotide programmable nucleotide binding domain coding sequence and a second vector containing the guide RNA coding sequence) or both can be part of a same molecule (e.g., one vector containing coding (and regulatory) sequence for both the polynucleotide programmable nucleotide binding domain and the guide RNA).

A guide polynucleotide can comprise one or more modifications to provide a nucleic acid with a new or enhanced feature. A guide polynucleotide can comprise a nucleic acid affinity tag. A guide polynucleotide can comprise synthetic nucleotide, synthetic nucleotide analog, nucleotide derivatives, and/or modified nucleotides.

In some embodiments, a gRNA or a guide polynucleotide can comprise modifications. A modification can be made at any location of a gRNA or a guide polynucleotide. More than one modification can be made to a single gRNA or a guide polynucleotide. A gRNA or a guide polynucleotide can undergo quality control after a modification. In some embodiments, quality control can include PAGE, HPLC, MS, or any combination thereof.

A modification of a gRNA or a guide polynucleotide can be a substitution, insertion, deletion, chemical modification, physical modification, stabilization, purification, or any combination thereof.

A gRNA or a guide polynucleotide can also be modified by 5'adenylate, 5' guanosine-triphosphate cap, 5'N7-Methylguanosine-triphosphate cap, 5'triphosphate cap, 3'phosphate, 3'thiophosphate, 5'phosphate, 5'thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2'-deoxyribonucleoside analog purine, 2'-deoxyribonucleoside analog pyrimidine, ribonucleoside analog, 2'-O-methyl ribonucleoside analog, sugar modified analogs, wobble/ universal bases, fluorescent dye label, 2'-fluoro RNA, 2'-O-methyl RNA, methylphosphonate, phosphodiester DNA, phosphodiester RNA, phosphothioate DNA, phosphorothioate RNA, UNA, pseudouridine-5'-triphosphate, 5'-methylcytidine-5'-triphosphate, or any combination thereof.

In some embodiments, a modification is permanent. In other embodiments, a modification is transient. In some embodiments, multiple modifications are made to a gRNA or a guide polynucleotide. A gRNA or a guide polynucleotide modification can alter physiochemical properties of a nucleotide, such as their conformation, polarity, hydrophobicity, chemical reactivity, base-pairing interactions, or any combination thereof.

A modification can also be a phosphorothioate substitute. In some embodiments, a natural phosphodiester bond can be susceptible to rapid degradation by cellular nucleases and; a modification of internucleotide linkage using phosphorothioate (PS) bond substitutes can be more stable towards hydrolysis by cellular degradation. A modification can increase stability in a gRNA or a guide polynucleotide. A modification can also enhance biological activity. In some embodiments, a phosphorothioate enhanced RNA gRNA can inhibit RNase A, RNase T1, calf serum nucleases, or any combinations thereof. These properties can allow the use of PS-RNA gRNAs to be used in applications where exposure to nucleases is of high probability in vivo or in vitro. For example, phosphorothioate (PS) bonds can be introduced between the last 3-5 nucleotides at the 5'- or "-end of a gRNA which can inhibit exonuclease degradation. In some embodiments, phosphorothioate bonds can be added throughout an entire gRNA to reduce attack by endonucleases.

In some embodiments, the guide RNA is designed to disrupt a splice site (i.e., a splice acceptor (SA) or a splice donor (SD). In some embodiments, the guide RNA is designed such that the base editing results in a premature STOP codon. Tables 4A-4B provide a non-exhaustive list of gRNA target sequences designed to disrupt a splice site or to result in a premature STOP codon.

TABLE 4A gRNAs: Splice Site and STOP Codons

| Gene | Description | Targeting sequence | SEQ ID NO: | gRNA Spacer Sequence | SEQ ID NO: |
|---|---|---|---|---|---|
| VISTA | Exon 1 SD (pos6) | CCTTACCTAGGGACGCAGCC | 295 | CCUUACCUAGGGACGCAGCC | 803 |
| | Exon 1 STOP (pos7) | GGATCCCCAGCGCCAGCTGC | 296 | GGAUCCCCAGCGCCAGCUGC | 804 |
| | Exon 1 STOP (pos5) | AGCGCCAGCTGCCGGCCTCC | 297 | AGCGCCAGCUGCCGGCCUCC | 805 |
| | Exon 1 STOP (pos4) | GCGCCAGCTGCCGGCCTCCA | 298 | GCGCCAGCUGCCGGCCUCCA | 806 |
| | Exon 2 STOP (pos8) | CCTGGCTCAGCGCCACGGGC | 299 | CCUGGCUCAGCGCCACGGGC | 807 |
| | Exon 2 STOP (pos5) | GCTGCAGGTGCAGACAGGTG | 300 | GCUGCAGGUGCAGACAGGUG | 808 |
| | Exon 2 STOP (pos7) | GCGGTACCACGTCTTGTAGA | 301 | GCGGUACCACGUCUUGUAGA | 809 |
| | Exon 3 SA (pos4) | TGCCTGTGGGAACAAACAGA | 302 | UGCCUGUGGGAACAAACAGA | 810 |
| | Exon 3 SD (pos5) | CTTACTTTCACTATCCTGGG | 303 | CUUACUUUCACUAUCCUGGG | 811 |
| | Exon 3 SD (pos8) | TCCCTTACTTTCACTATCCT | 304 | UCCCUUACUUUCACUAUCCU | 812 |
| | Exon 3 STOP (pos5) | CTCCCAGGATAGTGAAAGTA | 305 | CUCCCAGGAUAGUGAAAGUA | 813 |
| | Exon 4 SA (pos7) | TGATGTCTGAAAGGGCAGAG | 306 | UGAUGUCUGAAAGGGCAGAG | 814 |
| | Exon 5 STOP (pos5) | TGCCCAGGAGCTGGTGCGGA | 307 | UGCCCAGGAGCUGGUGCGGA | 815 |
| | Exon 6 SA (pos4) | TTGCTGCCACAGAACCAGAA | 308 | UUGCUGCCACAGAACCAGAA | 816 |
| | Exon 6 STOP (pos4) | ATTCAAGGGATTGAAAACCC | 309 | AUUCAAGGGAUUGAAAACCC | 817 |
| | Exon 6 STOP (pos8) | ACCTGCCCAGGGGATACCCG | 310 | ACCUGCCCAGGGGAUACCCG | 818 |
| | Exon 6 STOP (pos7) | CAGCGGCAGCCTTCTGAGTC | 311 | CAGCGGCAGCCUUCUGAGUC | 819 |
| TRAC | Exon 1 STOP 1 (pos5) | GCTACAAACAAGCTCATCTT | 312 | GCUACAAACAAGCUCAUCUU | 820 |
| | Exon 1 STOP 2 (pos6) | CCAGCCAAGTACGTAAGTAG | 313 | CCAGCCAAGUACGUAAGUAG | 821 |
| | Exon 2 SA (pos9) | CTGGATATCTGTGGGACAAG | 314 | CUGGAUAUCUGUGGGACAAG | 822 |
| | Exon 2 SD | CTTACCTGGGCTGGGGAAGA | 315 | CUUACCUGGGCUGGGGAAGA | 823 |
| | Exon 4 SA | TTCGTATCTGTAAAACCAAG | 316 | UUCGUAUCUGUAAAACCAAG | 824 |
| | Exon 4 STOP | TTTCAAAACCTGTCAGTGAT | 317 | UUUCAAAACCUGUCAGUGAU | 825 |
| | Exon 4 STOP | TTCAAAACCTGTCAGTGATT | 318 | UUCAAAACCUGUCAGUGAUU | 826 |
| Tim-3 | Exon 2 SA (pos6) | GGACCCTGCATAGAGAGAGA | 319 | GGACCCUGCAUAGAGAGAGA | 827 |
| | Exon 2 STOP (pos5) | TGCCCCAGCAGACGGGCACG | 320 | UGCCCCAGCAGACGGGCACG | 828 |
| | Exon 3 SD (pos5) | GTTACCTGGGCCATGTCCCC | 321 | GUUACCUGGGCCAUGUCCCC | 829 |
| | Exon 4 SD (pos5) | CTTACTGTTAGATTTATATC | 322 | CUUACUGUUAGAUUUAUAUC | 830 |
| | Exon 4 SD (pos4) | TTACTGTTAGATTTATATCA | 323 | UUACUGUUAGAUUUAUAUCA | 831 |
| | Exon 5 SA (pos5) | TTTGCTATGGAAACACAAAC | 324 | UUUGCUAUGGAAACACAAAC | 832 |
| | Exon 5 STOP (pos8) | TCCATAGCAAATATCCACAT | 325 | UCCAUAGCAAAUAUCCACAU | 833 |
| | Exon 7 STOP (pos5) | GCAGCAACCCTCACAACCTT | 326 | GCAGCAACCCUCACAACCUU | 834 |
| | Exon 7 STOP (pos 4) | CAGCAACCCTCACAACCTTT | 327 | CAGCAACCCUCACAACCUUU | 835 |
| TIGIT | Exon 1 STOP (pos4) | AGGCAGGCTCCCCTCGCCTC | 328 | AGGCAGGCUCCCCUCGCCUC | 836 |
| | Exon 2 STOP (5&8) | GGAGCAGCAGGACCAGCTTC | 329 | GGAGCAGCAGGACCAGCUUC | 837 |
| | Exon 2 SD (pos9) | CAGGAATACCTGAGCTTTCT | 330 | CAGGAAUACCUGAGCUUUCU | 838 |
| | Exon 3 STOP (pos7) | AGGTTCCAGATTCCATTGCT | 331 | AGGUUCCAGAUUCCAUUGCU | 839 |
| | Exon 1 STOP | CTGGGCCCAGGGGCTGAGGC | 332 | CUGGGCCCAGGGGCUGAGGC | 840 |
| | Exon 2 STOP | GATCGAGTGGCCCCAGGTCC | 333 | GAUCGAGUGGCCCCAGGUCC | 841 |
| TGFbRII | Exon 1 SD (JMG79) | TCACCCGACTTCTGAACGTG | 334 | UCACCCGACUUCUGAACGUG | 842 |
| | Exon 3 SD (JMG83) | TTACCTGCCCACTGTTAGCC | 335 | UUACCUGCCCACUGUUAGCC | 843 |
| | Exon 2 STOP (JMG80) | GAAGCCACAGGAAGTCTGTG | 336 | GAAGCCACAGGAAGUCUGUG | 844 |
| | Exon 3 STOP (JMG81) | ACTCCAGTTCCTGACGGCTG | 337 | ACUCCAGUUCCUGACGGCUG | 845 |
| | Exon 3 STOP (JMG82) | ACCTACAGGAGTACCTGACG | 338 | ACCUACAGGAGUACCUGACG | 846 |
| | Exon 4 STOP (JMG84) | TTCCCAGAGCACCAGAGCCA | 339 | UUCCCAGAGCACCAGAGCCA | 847 |
| | Exon 1 STOP (JMG85) | ACGTTCAGAAGTCGGGTGAG | 340 | ACGUUCAGAAGUCGGGUGAG | 848 |
| | Exon 3 STOP (pos8) | TTCAGAGCAGTTTGAGACAG | 341 | UUCAGAGCAGUUUGAGACAG | 849 |
| RFXANK | Exon 2 SA (JMG8) | CCTGCTGGGAAACAGACAAC | 342 | CCUGCUGGGAAACAGACAAC | 850 |
| | Exon 2 SD (JMG9) | CACTCACAGTCTAGGGTGGC | 343 | CACUCACAGUCUAGGGUGGC | 851 |
| | Exon 2 STOP (pos8) | CAACCGGCAGCGAGGGAACG | 344 | CAACCGGCAGCGAGGGAACG | 1504 |
| | Exon 3 SA (pos7) | ACAGGGCTGGGGCAGGACAG | 345 | ACAGGGCUGGGGCAGGACAG | 852 |
| | Exon 3 STOP (pos8) | CATCCACCAGCTCGCAGCAC | 346 | CAUCCACCAGCUCGCAGCAC | 853 |
| | Exon 3 STOP (pos7) | ATCCACCAGCTCGCAGCACA | 347 | AUCCACCAGCUCGCAGCACA | 854 |
| | Exon 3 STOP (pos6) | TCCACCAGCTCGCAGCACAG | 348 | UCCACCAGCUCGCAGCACAG | 855 |
| | Exon 3 STOP (pos5) | CCACCAGCTCGCAGCACAGG | 349 | CCACCAGCUCGCAGCACAGG | 856 |
| | Exon 4 SA (JMG10) | TGTCACCTGGCAGGAGGAGG | 350 | UGUCACCUGGCAGGAGGAGG | 857 |
| | Exon 4 SA (pos6) | GTCACCTGGCAGGAGGAGGC | 351 | GUCACCUGGCAGGAGGAGGC | 858 |
| | Exon 5 SA (pos7) | GGCACCCTGCAGGGAGAAGA | 352 | GGCACCCUGCAGGGAGAAGA | 859 |
| | Exon 5 SA (JMG11) | GCACCCTGCAGGGAGAAGAA | 353 | GCACCCUGCAGGGAGAAGAA | 860 |
| | Exon 6 SA (pos4) | ATTCTGTCGTGGGTAGGGGC | 354 | AUUCUGUCGUGGGUAGGGGC | 861 |
| | Exon 6 SA (JMG12) | CTCCATTCTGTCGTGGGTAG | 355 | CUCCAUUCUGUCGUGGGUAG | 862 |

TABLE 4A-continued

| | | gRNAs: Splice Site and STOP Codons | | | |
|---|---|---|---|---|---|
| Gene | Description | Targeting sequence | SEQ ID NO: | gRNA Spacer Sequence | SEQ ID NO: |
| | Exon 7 SA (pos8) | CCTCGGGCTGCAAAGGAGAG | 356 | CCUCGGGCUGCAAAGGAGAG | 863 |
| | Exon 7 SA (pos5) | CGGGCTGCAAAGGAGAGGGG | 357 | CGGGCUGCAAAGGAGAGGGG | 864 |
| | Exon 7 SD (pos6) | GCTGACCTTTCCGGTATCCC | 358 | GCUGACCUUUCCGGUAUCCC | 865 |
| | Exon 7 SD (pos5) | CTGACCTTTCCGGTATCCCA | 359 | CUGACCUUUCCGGUAUCCCA | 866 |
| | Exon 8 SA (pos8) | TGTTGCACTGAGATGGGGCA | 360 | UGUUGCACUGAGAUGGGGCA | 867 |
| | Exon 8 SA (pos9) | CTGTTGCACTGAGATGGGGC | 361 | CUGUUGCACUGAGAUGGGGC | 868 |
| PVRIG | Exon 1 STOP (pos7) | GCCCTGCAGCCCCCAGAACC | 362 | GCCCUGCAGCCCCCAGAACC | 869 |
| (CD112R) | Exon 1 SD (pos5) | CTCACCCGCAGTGACACACA | 363 | CUCACCCGCAGUGACACACA | 870 |
| | Exon 1 STOP (pos8) | GCAGCACCCAGGGCAGGACC | 364 | GCAGCACCCAGGGCAGGACC | 1505 |
| | Exon 1 STOP (pos7) | CAGCACCCAGGGCAGGACCA | 365 | CAGCACCCAGGGCAGGACCA | 1506 |
| | Exon 2 SA (pos5) | GTCCCTGTGGAACAGCAGCA | 366 | GUCCCUGUGGAACAGCAGCA | 871 |
| | Exon 2 STOP (pos8) | GTGGGTTCAAGTTCGGATGG | 367 | GUGGGUUCAAGUUCGGAUGG | 872 |
| | Exon 2 SD (pos 7) | GCCCCACCTGGGTCTGAGCT | 368 | GCCCCACCUGGGUCUGAGCU | 873 |
| | Exon 2 SD (pos8) | GGCCCCACCTGGGTCTGAGC | 369 | GGCCCCACCUGGGUCUGAGC | 874 |
| | Exon 2 SD (pos4) | CCACCTGGGTCTGAGCTGGG | 370 | CCACCUGGGUCUGAGCUGGG | 875 |
| | Exon 2 STOP (pos8) | AGGCCTCCCAGGAGCCCTCA | 371 | AGGCCUCCCAGGAGCCCUCA | 876 |
| | Exon 2 STOP (pos4) | CTCCCAGGAGCCCTCAGGGA | 372 | CUCCCAGGAGCCCUCAGGGA | 877 |
| | Exon 2 STOP (pos4) | CCCCCAGCTCACAGTCACCA | 373 | CCCCCAGCUCACAGUCACCA | 878 |
| | Exon 3 SD (pos8) | GGTCTCACCGGTGCTTATGT | 374 | GGUCUCACCGGUGCUUAUGU | 879 |
| | Exon 3 STOP (pos9) | TGCTGCGCCGACATAAGCAC | 375 | UGCUGCGCCGACAUAAGCAC | 880 |
| | Exon 4 SA (pos8) | GGCAGGGCTGGGAGAGAGCA | 376 | GGCAGGGCUGGGAGAGAGCA | 881 |
| | Exon 4 STOP (pos9) | CGAGAGCACGAGCATGGGTG | 377 | CGAGAGCACGAGCAUGGGUG | 882 |
| | Exon 4 STOP (pos6) | GAGCACGAGCATGGGTGAGG | 378 | GAGCACGAGCAUGGGUGAGG | 883 |
| | Exon 4 STOP (pos5) | AGCACGAGCATGGGTGAGGA | 379 | AGCACGAGCAUGGGUGAGGA | 884 |
| | Exon 4 STOP (pos4) | GCACGAGCATGGGTGAGGAG | 380 | GCACGAGCAUGGGUGAGGAG | 885 |
| | Exon 4 SD (pos5) | CTCACCCATGCTCGTGCTCT | 381 | CUCACCCAUGCUCGUGCUCU | 886 |
| | Exon 5 SA (pos6) | GGTGCCTGCGCGGGGGAAGG | 382 | GGUGCCUGCGCGGGGGAAGG | 887 |
| | Exon 5 SA (pos5) | GTGCCTGCGCGGGGGAAGGA | 383 | GUGCCUGCGCGGGGGAAGGA | 888 |
| | Exon 5 SA (pos9) | CTTGGTGCCTGCGCGGGGGA | 384 | CUUGGUGCCUGCGCGGGGGA | 889 |
| | Exon 5 STOP (pos6) | GGCCCCAGGGCCCTGCCGCC | 385 | GGCCCCAGGGCCCUGCCGCC | 890 |
| | Exon 5 STOP (pos9) | TCTACGCTCAGGCAGGGGAG | 386 | UCUACGCUCAGGCAGGGGAG | 891 |
| | Exon 5 STOP (pos4) | CCACCAGGACGGCCCCCCAT | 387 | CCACCAGGACGGCCCCCCAU | 892 |
| | Exon 5 STOP (pos5) | AGGCCCAGGCGGCAGGGCCC | 388 | AGGCCCAGGCGGCAGGGCCC | 1507 |
| | Exon 5 STOP (pos4) | GGCCCAGGCGGCAGGGCCCT | 389 | GGCCCAGGCGGCAGGGCCCU | 893 |
| PDCD1 | Exon 1 STOP 2 (pos9) | ACGACTGGCCAGGGCGCCTG | 390 | ACGACUGGCCAGGGCGCCUG | 894 |
| | Exon 1 STOP 4 (pos7) | CACCGCCCAGACGACTGGCC | 391 | CACCGCCCAGACGACUGGCC | 895 |
| | Exon 1 STOP (pos4) | CTACAACTGGGCTGGCGGCC | 392 | CUACAACUGGGCUGGCGGCC | 896 |
| | Exon 1 SD | CACCTACCTAAGAACCATCC | 202 | CACCUACCUAAGAACCAUCC | 897 |
| | Exon 2 SA | GGAGTCTGAGAGATGGAGAG | 393 | GGAGUCUGAGAGAUGGAGAG | 898 |
| | Exon 2 STOP 1 (pos8) | CAGCAACCAGACGGACAAGC | 394 | CAGCAACCAGACGGACAAGC | 1508 |
| | Exon 2 STOP 2 (pos9) | GTGTCACACAACTGCCCAAC | 395 | GUGUCACACAACUGCCCAAC | 899 |
| | Exon 3 STOP 1 (pos8) | AGCCGGCCAGTTCCAAACCC | 396 | AGCCGGCCAGUUCCAAACCC | 900 |
| | Exon 3 STOP (pos7) | CAGTTCCAAACCCTGGTGGT | 397 | CAGUUCCAAACCCUGGUGGU | 901 |
| | Exon 3 STOP 2 (pos5) | CGGCCAGTTCCAAACCCTGG | 398 | CGGCCAGUUCCAAACCCUGG | 902 |
| | Exon 3 STOP (pos5) | GGACCCAGACTAGCAGCACC | 399 | GGACCCAGACUAGCAGCACC | 903 |
| | Exon 3 SD | GACGTTACCTCGTGCGGCCC | 400 | GACGUUACCUCGUGCGGCCC | 904 |
| | Exon 4 SA | TCCCTGCAGAGAAACACACT | 401 | UCCCUGCAGAGAAACACACU | 905 |
| | Exon 4 SD | GAGACTCACCAGGGGCTGGC | 402 | GAGACUCACCAGGGGCUGGC | 906 |
| | Exon 5 SA | CCTCCTTCTTTGAGGAGAAA | 403 | CCUCCUUCUUUGAGGAGAAA | 907 |
| | Exon 2 STOP (pos 7) | GGGGTTCCAGGGCCTGTCTG | 203 | GGGGUUCCAGGGCCUGUCUG | 908 |
| | Exon 3 SA | TTCTCTCTGGAAGGGCACAA | 404 | UUCUCUCUGGAAGGGCACAA | 909 |
| | Exon 5 STOP 1 (pos 8) | CCAGTGGCGAGAGAAGACCC | 405 | CCAGUGGCGAGAGAAGACCC | 910 |
| | Exon 5 STOP 2 (pos 5) | TGCCCAGCCACTGAGGCCTG | 406 | UGCCCAGCCACUGAGGCCUG | 911 |
| | Exon 1 STOP 1 (pos8) | CGACTGGCCAGGGCGCCTGT | 407 | CGACUGGCCAGGGCGCCUGU | 912 |
| | Exon 1 STOP 3 (pos6) | ACCGCCCAGACGACTGGCCA | 408 | ACCGCCCAGACGACUGGCCA | 913 |
| Lag3 | Exon 1 STOP (pos8) | GTTTCTGCAGCCGCTTTGGG | 409 | GUUUCUGCAGCCGCUUUGGG | 914 |
| | Exon 1 SD (pos4) | TTACCTGGAGCCACCCAAAG | 410 | UUACCUGGAGCCACCCAAAG | 915 |
| | Exon 2 SA (pos4) | TCACTAGGTGAGCAAAAGAG | 411 | UCACUAGGUGAGCAAAAGAG | 916 |
| | Exon 2 STOP (pos8) | GCCTCTCCAGCCAGGGGCTG | 412 | GCCUCUCCAGCCAGGGGCUG | 917 |
| | Exon 2 STOP (pos 6) | CTTGGCAGCATCAGCCAGAC | 413 | CUUGGCAGCAUCAGCCAGAC | 918 |
| | Exon 3 SA (pos4) | CCACTGGGCGGGAAAGAGAA | 414 | CCACUGGGCGGGAAAGAGAA | 919 |
| | Exon 3 SD (pos6) | ACATACTCGAGGCCTGGCCC | 415 | ACAUACUCGAGGCCUGGCCC | 920 |
| | Exon 3 STOP (pos5) | CCTGCAGCCCCGCGTCCAGC | 416 | CCUGCAGCCCCGCGUCCAGC | 92 |
| | Exon 3 STOP (pos7) | CGCGTCCAGCTGGATGAGCG | 417 | CGCGUCCAGCUGGAUGAGCG | 922 |
| | Exon 3 STOP (pos6) | TGGGCCAGGCCTCGAGTATG | 418 | UGGGCCAGGCCUCGAGUAUG | 923 |
| | Exon 4 SD (pos4) | GGGAGTTACCCAGAACAGTG | 419 | GGGAGUUACCCAGAACAGUG | 924 |
| | Exon 4 STOP (pos8) | CCTGCCCCAAGTCAGCCCCA | 420 | CCUGCCCCAAGUCAGCCCCA | 925 |
| | Exon 4 STOP (pos9) | GCCAGGGCCGAGTCCCTGTC | 421 | GCCAGGGCCGAGUCCCUGUC | 926 |
| | Exon 4 STOP (pos8) | CCAGGGCCGAGTCCCTGTCO | 422 | CCAGGGCCGAGUCCCUGUCC | 927 |
| | Exon 4 STOP (pos4) | GCCCCAGGGCCCAGAGTCCA | 423 | GCCCCAGGGCCCAGAGUCCA | 928 |
| | Exon 5 STOP (pos9) | ATGTGAGCCAGGCCCAGGCT | 424 | AUGUGAGCCAGGCCCAGGCU | 929 |
| | Exon 5 STOP (pos 8) | GAGGAGTCCACTTGGCAGTG | 425 | GAGGAGUCCACUUGGCAGUG | 930 |
| | Exon 6 SA (pos7) | GAGTCACTGAAAAGAGTAGA | 426 | GAGUCACUGAAAAGAGUAGA | 931 |

TABLE 4A-continued

| gRNAs: Splice Site and STOP Codons | | | | | |
|---|---|---|---|---|---|
| Gene | Description | Targeting sequence | SEQ ID NO: | gRNA Spacer Sequence | SEQ ID NO: |
|  | Exon 6 STOP (pos6) | CTGGACAAGAACGCTTTGTG | 427 | CUGGACAAGAACGCUUUGUG | 932 |
|  | Exon 6 STOP (pos7) | CCATCCCAGAGGAGTTTCTC | 428 | CCAUCCCAGAGGAGUUUCUC | 933 |
|  | Exon 6 STOP (pos4) | TGGCAATGCCAGCTGTACCA | 429 | UGGCAAUGCCAGCUGUACCA | 934 |
|  | Exon 6 STOP (pos4) | TACCAGGGGGAGAGGCTTCT | 430 | UACCAGGGGGAGAGGCUUCU | 935 |
|  | Exon 6 STOP (pos8) | GGCATTGCCAAGGCTGGGAA | 431 | GGCAUUGCCAAGGCUGGGAA | 936 |
|  | Exon 7 SA (pos6) | GGCACCTATGGAGAAAGTAC | 432 | GGCACCUAUGGAGAAAGUAC | 937 |
|  | Exon 7 STOP (pos4) | AGACAGGTGAGCCAGGGACA | 433 | AGACAGGUGAGCCAGGGACA | 938 |
|  | Exon 7 SD (pos7) | GGCTCACCTGTCTTCTCCAA | 434 | GGCUCACCUGUCUUCUCCAA | 939 |
|  | Exon 8 SA (pos8) | GTCGCCACTGTGAGAAGAGA | 435 | GUCGCCACUGUGAGAAGAGA | 940 |
|  | Exon 8 STOP (pos8) | GCAGGCTCAGAGCAAGATAG | 436 | GCAGGCUCAGAGCAAGAUAG | 941 |
|  | Exon 8 STOP (pos8) | GCTGGAGCAAGAACCGGAGC | 437 | GCUGGAGCAAGAACCGGAGC | 942 |
| CTLA-4 | Exon 1 SD (pos 6) | ACTCACCTTTGCAGAAGACA | 438 | ACUCACCUUUGCAGAAGACA | 943 |
|  | Exon 1 SD | CACTCACCTTTGCAGAAGAC | 439 | CACUCACCUUUGCAGAAGAC | 944 |
|  | Exon 1 STOP (pos5) | AGGGCCAGGTCCTGGTAGCC | 440 | AGGGCCAGGUCCUGGUAGCC | 945 |
|  | Exon 2 STOP | GGCCCAGCCTGCTGTGGTAC | 441 | GGCCCAGCCUGCUGUGGUAC | 946 |
|  | Exon 2 STOP (pos 8) | GCTTCGGCAGGCTGACAGCC | 442 | GCUUCGGCAGGCUGACAGCC | 947 |
|  | Exon 2 STOP | TATCCAAGGACTGAGGGCCA | 443 | UAUCCAAGGACUGAGGGCCA | 948 |
|  | Exon 2 STOP | GGAACCCAGATTTATGTAAT | 444 | GGAACCCAGAUUUAUGUAAU | 949 |
|  | Exon 2 SD | GCTCACCAATTACATAAATC | 445 | GCUCACCAAUUACAUAAAUC | 950 |
|  | Exon 2 SD | CTCACCAATTACATAAATCT | 446 | CUCACCAAUUACAUAAAUCU | 951 |
|  | Exon 1 STOP | CTCAGCTGAACCTGGCTACC | 447 | CUCAGCUGAACCUGGCUACC | 952 |
| Chi3l1 | Exon 1 STOP (pos8) | GGCGTCTCAAACAGGTATCT | 448 | GGCGUCUCAAACAGGUAUCU | 953 |
|  | Exon 1 SA (pos7) | CAAAGCCTGAAGAGAAATCC | 449 | CAAAGCCUGAAGAGAAAUCC | 954 |
|  | Exon 3 SA (pos6) | AGAGCCTGAAGGAGAAGTCT | 450 | AGAGCCUGAAGGAGAAGUCU | 955 |
|  | Exon 3 STOP (pos4) | TCCCAGTACCGGGAAGGCGA | 451 | UCCCAGUACCGGGAAGGCGA | 956 |
|  | Exon 4 SA (pos6) | GGTTCCTGTGGAGCACAGGG | 452 | GGUUCCUGUGGAGCACAGGG | 957 |
|  | Exon 4 SA (pos9) | TGGGGTTCCTGTGGAGCACA | 453 | UGGGGUUCCUGUGGAGCACA | 958 |
|  | Exon 6 SA (pos8) | TCATTTCCTAGATGGGAGAC | 454 | UCAUUUCCUAGAUGGGAGAC | 959 |
|  | Exon 6 SA (pos4) | TTCCTAGATGGGAGACAGGC | 455 | UUCCUAGAUGGGAGACAGGC | 960 |
|  | Exon 8 SA (pos9) | CCAGGTGTCTGAGGAGGAAG | 456 | CCAGGUGUCUGAGGAGGAAG | 961 |
|  | Exon 8 SA (pos5) | GTGTCTGAGGAGGAAGGGGA | 457 | GUGUCUGAGGAGGAAGGGGA | 962 |
|  | Exon 9 SA (pos6) | TAGTCCTGGGTGGGGTAGGG | 458 | UAGUCCUGGGUGGGGUAGGG | 963 |
|  | Exon 9 SA (pos5) | AGTCCTGGGTGGGGTAGGGT | 459 | AGUCCUGGGUGGGGUAGGGU | 964 |
|  | Exon 9 SD (pos6) | CATTACCTCATAGTAGGCAA | 460 | CAUUACCUCAUAGUAGGCAA | 965 |
|  | Exon 9 SD (pos7) | CCATTACCTCATAGTAGGCA | 461 | CCAUUACCUCAUAGUAGGCA | 966 |
|  | Exon 10 SA (pos7) | ACAGATCTGAGCAGATAACA | 462 | ACAGAUCUGAGCAGAUAACA | 967 |
|  | Exon 10 STOP (pos 7) | TCCTACCCACTGGTTGCCCT | 463 | UCCUACCCACUGGUUGCCCU | 968 |
|  | Exon 11 STOP (pos7) | AGGTGCAGTACCTGAAGGAC | 464 | AGGUGCAGUACCUGAAGGAC | 969 |
|  | Exon 11 STOP (pos5) | CAGGCAGCTGGCGGGCGCCA | 465 | CAGGCAGCUGGCGGGCGCCA | 970 |
|  | Exon 11 STOP (pos7) | GACTTCCAGGGCTCCTTCTG | 466 | GACUUCCAGGGCUCCUUCUG | 971 |
| CD96 | Exon 1 STOP (pos5) | CATCCAGATACATTTTGTCA | 467 | CAUCCAGAUACAUUUUGUCA | 972 |
|  | Exon 2 STOP (pos5) | ACCTGCCAAACACAGACAGT | 468 | ACCUGCCAAACACAGACAGU | 973 |
|  | Exon 2 STOP (pos7) | CGTGCAGATGCAATGGTCCA | 469 | CGUGCAGAUGCAAUGGUCCA | 974 |
|  | Exon 3 SA (pos6) | TGTAACTGTAACAAAACATA | 470 | UGUAACUGUAACAAAACAUA | 975 |
|  | Exon 3 SD (pos6) | ACTTACCACCGACCATGCAT | 471 | ACUUACCACCGACCAUGCAU | 976 |
|  | Exon 5 SD (pos5) | CTTACCAAAAACCTTGACTG | 472 | CUUACCAAAAACCUUGACUG | 977 |
|  | Exon 5 STOP (pos6) | CCAGTCCAAATCTTCGATGA | 473 | CCAGUCCAAAUCUUCGAUGA | 978 |
|  | Exon 5 STOP (pos7) | CAGTCCAAATCTTCGATGAT | 474 | CAGUCCAAAUCUUCGAUGAU | 979 |
|  | Exon 7 STOP (pos4) | AAACCATGTGATATTTGCTT | 475 | AAACCAUGUGAUAUUUGCUU | 980 |
|  | Exon 8 STOP (pos6) | ATGTTCCACACTTTATTTCC | 476 | AUGUUCCACACUUUAUUUCC | 981 |
|  | Exon 10 SD (pos4) | TCACGTTGAGGAGTGGTGTT | 477 | UCACGUUGAGGAGUGGUGUU | 982 |
|  | Exon 13 SA (pos7) | CATTGTCTAGGGATATAAAG | 478 | CAUUGUCUAGGGAUAUAAAG | 983 |
|  | Exon 13 SA (pos8) | ACATTGTCTAGGGATATAAA | 479 | ACAUUGUCUAGGGAUAUAAA | 984 |
|  | Exon 13 SA (pos9) | GACATTGTCTAGGGATATAA | 480 | GACAUUGUCUAGGGAUAUAA | 985 |
|  | Exon 14 STOP (pos4) | TGGCCAGGACATTCCATCTT | 481 | UGGCCAGGACAUUCCAUCUU | 986 |
|  | Exon 15 SA (pos6) | CCATTCTAGGAACAAAATAT | 482 | CCAUUCUAGGAACAAAAUAU | 987 |
| Cblb | Exon 1 STOP | GAGCTTCCAAGTCTTCTCCA | 483 | GAGCUUCCAAGUCUUCUCCA | 988 |
|  | Exon 1 STOP (JMG44) | TCCCCGAAAAGGTCGAATTT | 484 | UCCCCGAAAAGGUCGAAUUU | 989 |
|  | Exon 2 STOP | ATGAAGAACAGTCACAGGAC | 485 | AUGAAGAACAGUCACAGGAC | 990 |
|  | Exon 3 SA | GATTTCGTCTGTAGGCACAA | 486 | GAUUUCGUCUGUAGGCACAA | 991 |
|  | Exon 4 SD | TAAACTTACCTGAAACAGCC | 487 | UAAACUUACCUGAAACAGCC | 992 |
|  | Exon 4 STOP | ATTCAGACAGTGCCTTCATG | 488 | AUUCAGACAGUGCCUUCAUG | 993 |
|  | Exon 6 STOP | GTTGCACTCGATTGGGACAG | 489 | GUUGCACUCGAUUGGGACAG | 994 |
|  | Exon 6 STOP | TTATTTCAAGCCCTGATTGA | 490 | UUAUUUCAAGCCCUGAUUGA | 995 |
|  | Exon 7 SD | TTACCTGTGTAACTTTTATA | 491 | UUACCUGUGUAACUUUUAUA | 996 |
|  | Exon 8 SA (pos8) | ATTGTTCCTGGAATTTGGGG | 492 | AUUGUUCCUGGAAUUUGGGG | 997 |
|  | Exon 8 SD (JMG48) | ATTATACCTGCCATGCCGTA | 493 | AUUAUACCUGCCAUGCCGUA | 998 |
|  | Exon 8 SA (pos 5) (JMG46) | GTTCCTGGAATTTGGGGAGG | 494 | GUUCCUGGAAUUUGGGGAGG | 999 |
|  | Exon 8 STOP (JMG47) | CTGCCATGCCGTAAGGCAAG | 495 | CUGCCAUGCCGUAAGGCAAG | 1000 |
|  | Exon 10 SD (JMG49) | TCTACCTTTGGTGAACCCGT | 496 | UCUACCUUUGGUGAACCCGU | 1001 |
|  | Exon 11 SD (JMG50) | CTTACCTTAGCTCCTTCTAA | 497 | CUUACCUUAGCUCCUUCUAA | 1002 |
|  | Exon 11 STOP | GGGATGTCGACTCCTAGGGG | 498 | GGGAUGUCGACUCCUAGGGG | 1003 |

TABLE 4A-continued

| | | | | | |
|---|---|---|---|---|---|
| | | gRNAs: Splice Site and STOP Codons | | | |
| Gene | Description | Targeting sequence | SEQ ID NO: | gRNA Spacer Sequence | SEQ ID NO: |
| | Exon 11 STOP | CGAGGGCACCATGCTTCAAG | 499 | CGAGGGCACCAUGCUUCAAG | 1004 |
| | Exon 12 SD | AAACTCACTTTATGCTAGGG | 500 | AAACUCACUUUAUGCUAGGG | 1005 |
| | Exon 12 SD (JMG51) | CTCACTTTATGCTAGGGAGG | 501 | CUCACUUUAUGCUAGGGAGG | 1006 |
| | Exon 16 SA (JMG52) | CTTCACCTGCATTTAAAGAA | 502 | CUUCACCUGCAUUUAAAGAA | 1007 |
| | Exon 4 STOP (JMG45) | CCACCAGATTAGCTCTGGCC | 503 | CCACCAGAUUAGCUCUGGCC | 1008 |
| | Exon 10 SD (pos4) | CTACCTTTGGTGAACCCGTT | 504 | CUACCUUUGGUGAACCCGUU | 1009 |
| BTLA | Exon 1 STOP (pos6) | ATGTTCCAGATGTCCAGATA | 505 | AUGUUCCAGAUGUCCAGAUA | 1010 |
| | Exon 1 STOP (pos5) | TGTTCCAGATGTCCAGATAT | 506 | UGUUCCAGAUGUCCAGAUAU | 1011 |
| | Exon 2 STOP (pos8) | AGATAGACAAACAAGTTGGA | 507 | AGAUAGACAAACAAGUUGGA | 1012 |
| | Exon 2 STOP (pos9) | AGCTTGCACCAAGTCACATG | 508 | AGCUUGCACCAAGUCACAUG | 1013 |
| | Exon 3 SD (pos6) | ACCCACCTTGGTGCCTTCTC | 509 | ACCCACCUUGGUGCCUUCUC | 1014 |
| B2M (BE) | Exon 1 SD | ACTCACGCTGGATAGCCTCC | 510 | ACUCACGCUGGAUAGCCUCC | 1015 |
| | Exon 2 SA (pos9) | TGGAGTACCTGAGGAATATC | 511 | UGGAGUACCUGAGGAAUAUC | 1016 |
| | Exon 2 STOP (pos6) | TTACCCCACTTAACTATCTT | 512 | UUACCCCACUUAACUAUCUU | 1017 |
| | Exon 3 SA | TCGATCTATGAAAAAGACAG | 513 | UCGAUCUAUGAAAAAGACAG | 1018 |
| | Exon 2 STOP | TACCCCACTTAACTATCT | 514 | UACCCCACUUAACUAUCU | 1019 |
| B2M (ABE) | Exon 1 SD 1 (pos 5) | ACTCACGCTGGATAGCCTCC | 510 | ACUCACGCUGGAUAGCCUCC | 1015 |
| | Exon 2 SA (pos 4) | CTCAGGTACTCCAAAGATTC | 515 | CUCAGGUACUCCAAAGAUUC | 1020 |
| | Exon 2 SD (pos 4) | CTTACCCCACTTAACTATCT | 516 | CUUACCCCACUUAACUAUCU | 1021 |
| TET2 | Exon 1 STOP 1 (pos 8) | CATTTGCCAGACAGAACCTC | 517 | CAUUUGCCAGACAGAACCUC | 1022 |
| | Exon 1 STOP 2 (pos 4) | AAACAAGACCAAAAGGCTAA | 518 | AAACAAGACCAAAAGGCUAA | 1023 |
| | Exon 1 STOP 3 (pos 7) | GTAAGCCAAGAAAGAAATCC | 519 | GUAAGCCAAGAAAGAAAUCC | 1024 |
| | Exon 1 STOP 4 (pos 5) | GCTTCAGATTCTGAATGAGC | 520 | GCUUCAGAUUCUGAAUGAGC | 1025 |
| | Exon 1 STOP 5 (pos 7) | TTAAAACAAATGAAATGAA | 521 | UUAAAACAAAUGAAAUGAA | 1026 |
| | Exon 1 STOP 6 (pos 7) | GTTCCTCAGCTTCCTTCAGA | 522 | GUUCCUCAGCUUCCUUCAGA | 1027 |
| | Exon 1 STOP 7 (pos 8) | CAAAGAGCAAGAGATTCTGA | 523 | CAAAGAGCAAGAGAUUCUGA | 1028 |
| | Exon 1 STOP 8 (pos 7) | AAAGAGCAAGAGATTCTGAA | 524 | AAAGAGCAAGAGAUUCUGAA | 1029 |
| | Exon 1 STOP 9 (pos 4) | ACACAGCACTATCTGAAACC | 525 | ACACAGCACUAUCUGAAACC | 1030 |
| | Exon 1 STOP 10 (pos 5) | CACCCAGAAAACAACACAGC | 526 | CACCCAGAAAACAACACAGC | 1509 |
| | Exon 1 STOP 11 (pos 4) | TACCAAGTTGAAATGAATCA | 527 | UACCAAGUUGAAAUGAAUCA | 1031 |
| | Exon 1 STOP 12 (pos 7) | ATGAATCAAGGGCAGTCCCA | 528 | AUGAAUCAAGGGCAGUCCCA | 1032 |
| | Exon 1 STOP 13 (pos 5) | AGGGCAGTCCCAAGGTACAG | 529 | AGGGCAGUCCCAAGGUACAG | 1033 |
| | Exon 1 STOP 14 (pos 5) | GTTCCAAAAACCCTCACACC | 530 | GUUCCAAAAACCCUCACACC | 1034 |
| | Exon 1 STOP 15 (pos 5) | GAAACAGCACTTGAATCAAC | 531 | GAAACAGCACUUGAAUCAAC | 1035 |
| | Exon 1 STOP 16 (pos 5) | ATTACAAATAAAGAATAAAG | 532 | AUUACAAAUAAAGAAUAAAG | 1036 |
| | Exon 1 STOP 17 (pos 8) | TAATGTCCAAATGGGACTGG | 533 | UAAUGUCCAAAUGGGACUGG | 1037 |
| | Exon 1 STOP 18 (pos 6) | CAAAGCAAGATCTTCTTCAC | 534 | CAAAGCAAGAUCUUCUUCAC | 1038 |
| | Exon 1 STOP 19 (pos 5) | ACAACAAGCTTCAGTTCTAC | 535 | ACAACAAGCUUCAGUUCUAC | 1039 |
| | Exon 1 STOP 20 (pos 6) | CTGCGCAACTTGCTCAGCAA | 536 | CUGCGCAACUUGCUCAGCAA | 1040 |
| | Exon 1 STOP 21 (pos 5) | CACTCAGACCCCTCCCCAGA | 537 | CACUCAGACCCCUCCCCAGA | 1041 |
| | Exon 1 STOP 22 (pos 6) | TTTTTCCATGTTTTGTTTTC | 538 | UUUUUCCAUGUUUUGUUUUC | 1042 |
| | Exon 1 SD (pos 4) | TTACCTACACATCTGCCAAGA | 539 | UUACCUACACAUCUGCCAAGA | 1043 |
| | Exon 3 SD (pos 8) | ACACTTACCCACTTAGCAAT | 540 | ACACUUACCCACUUAGCAAU | 1044 |
| | Exon 7 STOP (pos 5) | CATGCAGAATGGCAGCACAT | 541 | CAUGCAGAAUGGCAGCACAU | 1045 |
| | Exon 8 STOP 1 (pos 6) | AAGCTCAGGAGGAGAAAAAA | 542 | AAGCUCAGGAGGAGAAAAAA | 1046 |
| | Exon 8 STOP 2 (pos 8) | CGCAAGCCAGGCTAAACAGT | 543 | CGCAAGCCAGGCUAAACAGU | 1047 |
| | Exon 9 STOP 1 (pos 8) | TTCTCCCCAGTCTCAGCCGA | 544 | UUCUCCCCAGUCUCAGCCGA | 1048 |
| | Exon 9 STOP 2 (pos 5) | TGGTCAGGAAAAGCAGCCAT | 545 | UGGUCAGGAAAAGCAGCCAU | 1049 |
| | Exon 9 STOP 3 (pos 7) | CTAGTCCAGGGTGTGGCTTC | 546 | CUAGUCCAGGGUGUGGCUUC | 1050 |
| Spry 1 | Exon 1 STOP 1 | CCCCAAAATCAACATGGCAG | 547 | CCCCAAAAUCAACAUGGCAG | 1051 |
| | Exon 1 STOP 2 | TGTGATCCAGCAGCCTTCTT | 548 | UGUGAUCCAGCAGCCUUCUU | 1052 |
| | Exon 1 STOP 3 | GACCAGATCAAGGCCATAAG | 549 | GACCAGAUCAAGGCCAUAAG | 1053 |
| | Exon 1 STOP 4 | CAAGACAAGAAAGCATGAA | 550 | CAAGACAAGAAAGCAUGAA | 1054 |
| | Exon 1 STOP 5 | CTGAACAGGGACTGTTAGGA | 551 | CUGAACAGGGACUGUUAGGA | 1055 |
| Spry 2 | Exon 1 STOP 1 | CCAGAGCTCAGAGTGGCAAC | 552 | CCAGAGCUCAGAGUGGCAAC | 1056 |
| | Exon 1 STOP 2 | TTGCTGCAGACGCCCCGTGA | 553 | UUGCUGCAGACGCCCCGUGA | 1057 |
| | Exon 1 STOP 3 | CTGCAGACGCCCCGTGACGG | 554 | CUGCAGACGCCCCGUGACGG | 1058 |
| | Exon 1 STOP 4 | CGACAAGCAGTGCCTTTGCT | 555 | CGACAAGCAGUGCCUUUGCU | 1059 |
| | Exon 1 STOP 5 | GCCCAGAACGTGATTGACTA | 556 | GCCCAGAACGUGAUUGACUA | 1060 |
| | Exon 1 STOP 6 | TGTGCCAGGGGTGTTATGAC | 557 | UGUGCCAGGGGUGUUAUGAC | 1061 |
| | Exon 1 STOP 7 | CAGATCCAGTCTGATGGCAG | 558 | CAGAUCCAGUCUGAUGGCAG | 1062 |
| | Exon 1 STOP 8 | TGTACACGATGGTCAGCCAT | 559 | UGUACACGAUGGUCAGCCAU | 1063 |
| CIITA | Exon 1 SD (pos 6) | TTTTACCTTGGGGCTCTGAC | 560 | UUUUACCUUGGGGCUCUGAC | 1064 |
| | Exon 1 STOP 1 (pos 6) | AGCCCCAAGGTAAAAAGGCC | 561 | AGCCCCAAGGUAAAAAGGCC | 1065 |
| | Exon 1 STOP 2 (pos 7) | GAGCCCCAAGGTAAAAAGGC | 562 | GAGCCCCAAGGUAAAAAGGC | 1066 |
| | Exon 2 STOP 1 (pos 8) | CAGCTCACAGTGTGCCACCA | 563 | CAGCUCACAGUGUGCCACCA | 1067 |
| | Exon 2 STOP 2 (pos 7) | TATGACCAGATGGACCTGGC | 564 | UAUGACCAGAUGGACCUGGC | 1068 |
| | Exon 4 STOP 1 (pos 8) | ACTGGACCAGTATGTCTTCC | 565 | ACUGGACCAGUAUGUCUUCC | 1069 |
| | Exon 4 STOP 2 (pos 8) | TGTCTTCCAGGACTCCCAGC | 566 | UGUCUUCCAGGACUCCCAGC | 1070 |

TABLE 4A-continued

| gRNAs: Splice Site and STOP Codons | | | | | |
|---|---|---|---|---|---|
| Gene | Description | Targeting sequence | SEQ ID NO: | gRNA Spacer Sequence | SEQ ID NO: |
| | Exon 7 STOP 1 (pos 7) | TTCAACCAGGAGCCAGCCTC | 567 | UUCAACCAGGAGCCAGCCUC | 1071 |
| | Exon 7 STOP 2 (pos 4) | GACCAGATTCCCAGTATGTT | 568 | GACCAGAUUCCCAGUAUGUU | 1072 |
| | Exon 7 SD (pos 8) | TAACATACTGGGAATCTGGT | 569 | UAACAUACUGGGAAUCUGGU | 1073 |
| | Exon 8 SA (pos 8) | AAAGGCACTGCAAGAGACAA | 570 | AAAGGCACUGCAAGAGACAA | 1074 |
| | Exon 8 STOP (pos 8) | CTCTGGCAAATCTCTGAGGC | 571 | CUCUGGCAAAUCUCUGAGGC | 1075 |
| | Exon 9 STOP 1 (pos 4) | AGCCAAGTACCCCCTCCCAG | 572 | AGCCAAGUACCCCCUCCCAG | 1076 |
| | Exon 9 STOP 2 (pos 7) | ACCTCCCGAGCAAACATGAC | 573 | ACCUCCCGAGCAAACAUGAC | 1077 |
| | Exon 9 SD (pos 6) | CCTTACCTGTCATGTTTGCT | 574 | CCUUACCUGUCAUGUUUGCU | 1078 |
| | Exon 10 SA (pos 5) | TGCTCTGGAGATGGAGAAGC | 575 | UGCUCUGGAGAUGGAGAAGC | 1079 |
| | Exon 10 STOP 1 (pos 7) | CCCACCCAATGCCCGGCAGC | 576 | CCCACCCAAUGCCCGGCAGC | 1080 |
| | Exon 10 STOP 2 (pos 4) | AGGCCATTTTGGAAGCTTGT | 577 | AGGCCAUUUUGGAAGCUUGU | 1081 |
| | Exon 11 SA (pos 8) | ACCGGCTCTGCAAAGGCCAG | 578 | ACCGGCUCUGCAAAGGCCAG | 1082 |
| | Exon 11 STOP 1 (pos 6) | TGGTGCAGGCCAGGCTGGAG | 579 | UGGUGCAGGCCAGGCUGGAG | 1083 |
| | Exon 11 STOP 3 (pos 7) | GAACGGCAGCTGGCCCAAGG | 580 | GAACGGCAGCUGGCCCAAGG | 1084 |
| | Exon 11 STOP 4 (pos 5) | GGCCCAAGGAGGCCTGGCTG | 581 | GGCCCAAGGAGGCCUGGCUG | 1085 |
| | Exon 11 STOP 5 (pos 5) | GACACGAGTGATTGCTGTGC | 582 | GACACGAGUGAUUGCUGUGC | 1086 |
| | Exon 11 STOP 5 (pos 6) | CTGGTCAGGGCAAGAGCTAT | 583 | CUGGUCAGGGCAAGAGCUAU | 1087 |
| | Exon 11 STOP 5 (pos 8) | GGGCCCACAGCCACTCGTGG | 584 | GGGCCCACAGCCACUCGUGG | 1088 |
| | Exon 11 STOP 6 (pos 4) | TTCCAGAAGAAGCTGCTCCG | 585 | UUCCAGAAGAAGCUGCUCCG | 1089 |
| | Exon 11 STOP 7 (pos 8) | CCTGGTCCAGAGCCTGAGCA | 586 | CCUGGUCCAGAGCCUGAGCA | 1090 |
| | Exon 11 STOP 8 (pos 8) | CAGACATCAAAGTACCCTAC | 587 | CAGACAUCAAAGUACCCUAC | 1091 |
| | Exon 11 STOP 9 (pos 5) | ACATCAAAGTACCCTACAGG | 588 | ACAUCAAAGUACCCUACAGG | 1092 |
| | Exon 11 STOP 10 (pos 4) | CGCCCAGGTCCTCACGTCTG | 589 | CGCCCAGGUCCUCACGUCUG | 1093 |
| | Exon 11 STOP 11 (pos 8) | CTTAGTCCAACACCCACCGC | 590 | CUUAGUCCAACACCCACCGC | 1094 |
| | Exon 11 STOP 12 (pos 8) | CCTCCTGCAATGCTTCCTGG | 591 | CCUCCUGCAAUGCUUCCUGG | 1095 |
| | Exon 11 STOP 13 (pos 8) | GAGCCAGCCACAGGGCCCC | 592 | GAGCCAGCCACAGGGCCCCC | 1510 |
| | Exon 11 STOP 14 (pos 6) | GGAAGCAGAAGGTGCTTGCG | 593 | GGAAGCAGAAGGUGCUUGCG | 1096 |
| | Exon 11 STOP 15 (pos 6) | GGCTGCAGCCGGGGACACTG | 594 | GGCUGCAGCCGGGGACACUG | 1097 |
| | Exon 11 STOP 16 (pos 4) | CTGCCAAATTCCAGCCTCCT | 595 | CUGCCAAAUUCCAGCCUCCU | 1098 |
| | Exon 11 STOP 17 (pos 8) | GGCGGGCCAAGACTTCTCCC | 596 | GGCGGGCCAAGACUUCUCCC | 1099 |
| | Exon 12 STOP 1 (pos 6) | AGACTCAGAGGTGAGAGGAG | 597 | AGACUCAGAGGUGAGAGGAG | 1100 |
| | Exon 14 SA (pos 4) | AGCCTAGGAGGCAAAGAGCA | 598 | AGCCUAGGAGGCAAAGAGCA | 1101 |
| | Exon 14 STOP 1 (pos 5) | CCCCCAGGCTTTCCCCAAAC | 599 | CCCCCAGGCUUUCCCCAAAC | 1102 |
| | Exon 14 SD (pos 4) | TCACTCCAGATGCTGCAGGG | 600 | UCACUCCAGAUGCUGCAGGG | 1103 |
| | Exon 15 SA (pos 4) | AGGCTGCAGGTGGAATCAGA | 601 | AGGCUGCAGGUGGAAUCAGA | 1104 |
| | Exon 15 STOP 1 (pos 8) | CTTCCCCCAGCTGAAGTCCT | 602 | CUUCCCCCAGCUGAAGUCCU | 1105 |
| | Exon 15 SD (pos 7) | CACTCACTTGAGGGTTTCCA | 603 | CACUCACUUGAGGGUUUCCA | 1106 |
| | Exon 16 SA (pos 5) | CAGACTGCGGGGACACAGTG | 604 | CAGACUGCGGGGACACAGUG | 1107 |
| | Exon 16 SD 1 (pos 8) | CCACTCACCTTAGCCTGAGC | 605 | CCACUCACCUUAGCCUGAGC | 1108 |
| | Exon 16 SD 2 (pos 7) | CACTCACCTTAGCCTGAGCA | 606 | CACUCACCUUAGCCUGAGCA | 1109 |
| | Exon 17 SA (pos 8) | GTACAAGCTGTCGGAAACAG | 607 | GUACAAGCUGUCGGAAACAG | 1110 |
| | Exon 17 SD 1 (pos 8) | ACACTCACTCCATCACCCGG | 608 | ACACUCACUCCAUCACCCGG | 1111 |
| | Exon 17 SD 2 (pos 7) | CACTCACTCCATCACCCGGA | 609 | CACUCACUCCAUCACCCGGA | 1112 |
| | Exon 18 STOP (pos 5) | CGTCCAGTACAACAAGTTCA | 610 | CGUCCAGUACAACAAGUUCA | 1113 |
| | Exon 19 SA 1 (pos 8) | CCACATCCTGCAAGGGGGGA | 611 | CCACAUCCUGCAAGGGGGGA | 1114 |
| | Exon 19 SA 2 (pos 9) | CACATCCTGCAAGGGGGGAT | 612 | CACAUCCUGCAAGGGGGGAU | 1115 |
| | Exon 19 STOP 1 (pos 8) | TGGGCGTCCACATCCTGCAA | 613 | UGGGCGUCCACAUCCUGCAA | 1116 |
| | Exon 19 STOP 2 (pos 7) | GGGCGTCCACATCCTGCAAG | 614 | GGGCGUCCACAUCCUGCAAG | 1117 |
| | Exon 19 STOP 3 (pos 6) | GGCGTCCACATCCTGCAAGG | 615 | GGCGUCCACAUCCUGCAAGG | 1118 |
| | Exon 19 STOP 4 (pos 5) | GCGTCCACATCCTGCAAGGG | 616 | GCGUCCACAUCCUGCAAGGG | 1119 |
| CD7 | Exon 1 STOP (pos 4) | GCCCAAGGTAAGAGCTTCCC | 617 | GCCCAAGGUAAGAGCUUCCC | 1120 |
| | Exon 1 SD 1 (pos 8) | GCTCTTACCTTGGGCAGCCA | 618 | GCUCUUACCUUGGGCAGCCA | 1121 |
| | Exon 1 SD 2 (pos 9) | AGCTCTTACCTTGGGCAGCC | 619 | AGCUCUUACCUUGGGCAGCC | 1122 |
| | Exon 2 SA 1 (pos 8) | TGCACCTCTGGGGAGGACCT | 620 | UGCACCUCUGGGGAGGACCU | 1123 |
| | Exon 2 SA 2 (pos 9) | CTGCACCTCTGGGGAGGACC | 621 | CUGCACCUCUGGGGAGGACC | 1124 |
| | Exon 2 STOP 1 (pos 7) | CGCCTGCAGCTGTCGGACAC | 622 | CGCCUGCAGCUGUCGGACAC | 1125 |
| | Exon 2 STOP 2 (pos 8) | CACCTGCCAGGCCATCACGG | 623 | CACCUGCCAGGCCAUCACGG | 1126 |
| | Exon 2 SD 1 (pos 6) | CCCTACCTGTCACCAGGACC | 624 | CCCUACCUGUCACCAGGACC | 1127 |
| | Exon 2 SD 2 (pos 5) | CCTACCTGTCACCAGGACCA | 625 | CCUACCUGUCACCAGGACCA | 1128 |
| | Exon 3 SA (pos 4) | CCTCTGAGAAGGAAAAAAGA | 626 | CCUCUGAGAAGGAAAAAAGA | 1129 |
| | Exon 3 STOP 1 (pos9) | CAGAGGAACAGTCCCAAGGA | 627 | CAGAGGAACAGUCCCAAGGA | 1130 |
| CD33 | Exon 1 SD 1 (pos 7) | CACTCACCTGCCCACAGCAG | 628 | CACUCACCUGCCCACAGCAG | 1131 |
| | Exon 1 SD 2 (pos 8) | CCACTCACCTGCCCACAGCA | 629 | CCACUCACCUGCCCACAGCA | 1132 |
| | Exon 1 SD (pos 9) | GCCACTCACCTGCCCACAGC | 630 | GCCACUCACCUGCCCACAGC | 1133 |
| | Exon 2 SA 1 (pos 8) | AGGGCCCCTGTGGGGAAACG | 631 | AGGGCCCCUGUGGGGAAACG | 1134 |
| | Exon 2 SA 2 (pos 7) | GGGCCCCTGTGGGGAAACGA | 632 | GGGCCCCUGUGGGGAAACGA | 1135 |
| | Exon 2 STOP 1 (pos 8) | GCAAGTGCAGGAGTCAGTGA | 633 | GCAAGUGCAGGAGUCAGUGA | 1136 |
| | Exon 2 STOP 2 (pos 6) | CGGAACCAGTAACCATGAAC | 634 | CGGAACCAGUAACCAUGAAC | 1137 |
| | Exon 2 STOP 3 (pos 5) | GGAACCAGTAACCATGAACT | 635 | GGAACCAGUAACCAUGAACU | 1138 |
| | Exon 2 STOP 4 (pos 4) | GAACCAGTAACCATGAACTG | 636 | GAACCAGUAACCAUGAACUG | 1139 |
| | Exon 2 STOP 5 (pos 8) | GCTAGATCAAGAAGTACAGG | 637 | GCUAGAUCAAGAAGUACAGG | 1140 |
| | Exon 2 STOP 6 (pos 8) | AGAAGTACAGGAGGAGACTC | 638 | AGAAGUACAGGAGGAGACUC | 1141 |
| | Exon 3 SA 1 (pos 6) | CAAGTCTAGTGAGGAGAAAG | 639 | CAAGUCUAGUGAGGAGAAAG | 1142 |
| | Exon 3 SA 2 (pos 5) | AAGTCTAGTGAGGAGAAAGA | 640 | AAGUCUAGUGAGGAGAAAGA | 1143 |

TABLE 4A-continued

| | | gRNAs: Splice Site and STOP Codons | | | |
|---|---|---|---|---|---|
| Gene | Description | Targeting sequence | SEQ ID NO: | gRNA Spacer Sequence | SEQ ID NO: |
| | Exon 3 SA 3 (pos 4) | AGTCTAGTGAGGAGAAAGAG | 641 | AGUCUAGUGAGGAGAAAGAG | 1144 |
| | Exon 3 STOP 1 (pos 7) | ACAGGCCCAGGACACAGAGC | 642 | ACAGGCCCAGGACACAGAGC | 1511 |
| | Exon 3 STOP 2 (pos 7) | ACCTGTCAGGTGAAGTTCGC | 643 | ACCUGUCAGGUGAAGUUCGC | 1145 |
| | Exon 3 SD 1 (pos 6) | ACTTACAGGTGACGTTGAGC | 644 | ACUUACAGGUGACGUUGAGC | 1146 |
| | Exon 4 SA 1 (pos 6) | AACATCTAGGAGAGGAAGAG | 645 | AACAUCUAGGAGAGGAAGAG | 1147 |
| | Exon 4 STOP 1 (pos 7) | GTTCCACAGAACCCAACAAC | 646 | GUUCCACAGAACCCAACAAC | 1148 |
| | Exon 4 SD 1 (pos 7) | TTCCTACCTGAGCCATCTCC | 647 | UUCCUACCUGAGCCAUCUCC | 1149 |
| | Exon 5 SD (pos 8) | ATGCTCACATGAAGAAGATG | 648 | AUGCUCACAUGAAGAAGAUG | 1150 |
| | Exon 5 STOP 1 (pos 7) | GGGAAACAAGAGACCAGAGC | 649 | GGGAAACAAGAGACCAGAGC | 1512 |
| | Exon 6 SA 1 (pos 6) | TCACTCTGATGGGAGACACC | 650 | UCACUCUGAUGGGAGACACC | 1151 |
| | Exon 6 SA 2 (pos 5) | CACTCTGATGGGAGACACCA | 651 | CACUCUGAUGGGAGACACCA | 1152 |
| | Exon 6 SA 1 (pos 4) | TTTCTTATGGAGAGGAAAGA | 652 | UUUCUUAUGGAGAGGAAAGA | 1153 |
| CD52 | Exon 1 STOP (pos 4) | GTACAGGTAAGAGCAACGCC | 653 | GUACAGGUAAGAGCAACGCC | 1154 |
| | Exon 1 SD (pos7) | CTCTTACCTGTACCATAACC | 654 | CUCUUACCUGUACCAUAACC | 1155 |
| | Exon 1 SD (pos 4) | TTACCTGTACCATAACCAGG | 655 | UUACCUGUACCAUAACCAGG | 1156 |
| | Exon 2 SA (pos 6) | TGTATCTGTAGGAGGAGAAG | 656 | UGUAUCUGUAGGAGGAGAAG | 1157 |
| | Exon 2 SA (pos 5) | GTATCTGTAGGAGGAGAAGT | 657 | GUAUCUGUAGGAGGAGAAGU | 1158 |
| | Exon 2 STOP (pos 7) | CAGATACAAACTGGACTCTC | 658 | CAGAUACAAACUGGACUCUC | 1159 |
| CD123 | Exon 1 SD (pos 6) | TCTTACCTTCCTTCGTTTGC | 659 | UCUUACCUUCCUUCGUUUGC | 1160 |
| | Exon 2 SA 1 (pos 8) | TTTGGATCTAAAACGGTGAC | 660 | UUUGGAUCUAAAACGGUGAC | 1161 |
| | Exon 2 SA 2 (pos 4) | GATCTAAAACGGTGACAGGT | 661 | GAUCUAAAACGGUGACAGGU | 1162 |
| | Exon 2 STOP 1 (pos 8) | AAAGGCTCAGCAGTTGACCT | 662 | AAAGGCUCAGCAGUUGACCU | 1163 |
| | Exon 2 SD (pos 6) | ATTTACCGGCATAGAATAGT | 663 | AUUUACCGGCAUAGAAUAGU | 1164 |
| | Exon 3 SA (pos 8) | TCACTGCCTAAGAGAGACAT | 664 | UCACUGCCUAAGAGAGACAU | 1165 |
| | Exon 3 STOP 1 (pos 6) | AGGATCCACGTGGAGAATGG | 665 | AGGAUCCACGUGGAGAAUGG | 1166 |
| | Exon 3 STOP 2 (pos 5) | GGATCCACGTGGAGAATGGT | 666 | GGAUCCACGUGGAGAAUGGU | 1167 |
| | Exon 3 SD (pos 6) | TCTCACTGTTCTCAGGGAAG | 667 | UCUCACUGUUCUCAGGGAAG | 1168 |
| | Exon 4 STOP 1 (pos 6) | CCTGCCCAAGGCTTCCCACC | 668 | CCUGCCCAAGGCUUCCCACC | 1169 |
| | Exon 4 STOP 2 (pos 5) | CTGCCCAAGGCTTCCCACCT | 669 | CUGCCCAAGGCUUCCCACCU | 1170 |
| | Exon 5 SA 1 (pos 6) | GCCTGCTGCGGTAAGCGGTA | 670 | GCCUGCUGCGGUAAGCGGUA | 1171 |
| | Exon 5 STOP 1 (pos 7) | GATGCTCAGGGAACACGTAT | 671 | GAUGCUCAGGGAACACGUAU | 1172 |
| | Exon 5 STOP 2 (pos 5) | TTCTCAAAGTTCCCACATCC | 672 | UUCUCAAAGUUCCCACAUCC | 1173 |
| | Exon 5 STOP 3 (pos 4) | TCACAGATTGGTGAGTAGCC | 673 | UCACAGAUUGGUGAGUAGCC | 1174 |
| | Exon 7 SD (pos 5) | CTCACCTGTTCTGTGATTAC | 674 | CUCACCUGUUCUGUGAUUAC | 1175 |
| | Exon 8 STOP 1 (pos 7) | TCCTTCCAGCTACTCAATCC | 675 | UCCUUCCAGCUACUCAAUCC | 1176 |
| | Exon 8 STOP 2 (pos 8) | CACAGTACAAATAAGAGCCC | 676 | CACAGUACAAAUAAGAGCCC | 1177 |
| | Exon 8 STOP 3 (pos 6) | CCCCCCAGCGCTTCGGTGAG | 677 | CCCCCCAGCGCUUCGGUGAG | 1178 |
| | Exon 8 STOP 4 (pos 5) | CCCCCAGCGCTTCGGTGAGT | 678 | CCCCCAGCGCUUCGGUGAGU | 1179 |
| | Exon 8 SD (pos 8) | CCACTCACCGAAGCGCTGGG | 679 | CCACUCACCGAAGCGCUGGG | 1180 |
| | Exon 10 SA (pos 4) | TACCTCGGAGGAAAGAGAAA | 680 | UACCUCGGAGGAAAGAGAAA | 1181 |
| | Exon 10 STOP (pos 8) | CAGCTTCCAAAACGACAAGC | 681 | CAGCUUCCAAAACGACAAGC | 1182 |
| | Exon 10 SD (pos 7) | AACATACCAGCTTGTCGTTT | 682 | AACAUACCAGCUUGUCGUUU | 1183 |
| | Exon 11 SA 1 (pos 8) | AGACCACCTGCAGAGACGAG | 683 | AGACCACCUGCAGAGACGAG | 1184 |
| | Exon 11 SA 2 (pos 5) | CCACCTGCAGAGACGAGAGG | 684 | CCACCUGCAGAGACGAGAGG | 1185 |
| TRBC1 | Exon 1 STOP 1 (pos 8) | CCACACCCAAAAGGCCACAC | 685 | CCACACCCAAAAGGCCACAC | 1500 |
| | Exon 1 STOP 2 (pos 5) | CCCACCAGCTCAGCTCCACG | 686 | CCCACCAGCUCAGCUCCACG | 1186 |
| | Exon 1 STOP 3 (pos 7) | CGCTGTCAAGTCCAGTTCTA | 687 | CGCUGUCAAGUCCAGUUCUA | 1187 |
| | Exon 1 STOP 4 (pos 6) | GCTGTCAAGTCCAGTTCTAC | 688 | GCUGUCAAGUCCAGUUCUAC | 1188 |
| | Exon 1 STOP 5 (pos 5) | CACCCAGATCGTCAGCGCCG | 689 | CACCCAGAUCGUCAGCGCCG | 1189 |
| | Exon 1 SD (pos 8) | CCACTCACCTGCTCTACCCC | 690 | CCACUCACCUGCUCUACCCC | 1190 |
| | Exon 2 SA (pos 8) | CCACAGTCTGAAAGAAAGCA | 691 | CCACAGUCUGAAAGAAAGCA | 1191 |
| | Exon 3 SA (pos 5) | GACACTGTTGGCACGGAGGA | 692 | GACACUGUUGGCACGGAGGA | 1192 |
| | Exon 3 SD (pos 4) | TTACCATGGCCATCAACACA | 693 | UUACCAUGGCCAUCAACACA | 1193 |
| TRBC2 | Exon 1 STOP 1 (pos 8) | CCACACCCAAAAGGCCACAC | 685 | CCACACCCAAAAGGCCACAC | 1500 |
| | Exon 1 STOP 2 (pos 5) | CCCACCAGCTCAGCTCCACG | 686 | CCCACCAGCUCAGCUCCACG | 1186 |
| | Exon 1 STOP 3 (pos 7) | CGCTGTCAAGTCCAGTTCTA | 687 | CGCUGUCAAGUCCAGUUCUA | 1187 |
| | Exon 1 STOP 4 (pos 6) | GCTGTCAAGTCCAGTTCTAC | 688 | GCUGUCAAGUCCAGUUCUAC | 1188 |
| | Exon 1 STOP 5 (pos 5) | CACCCAGATCGTCAGCGCCG | 689 | CACCCAGAUCGUCAGCGCCG | 1189 |
| | Exon 2 SA (pos 8) | CCACAGTCTGAAAGAAAACA | 694 | CCACAGUCUGAAAGAAAACA | 1194 |
| | Exon 2 SA (pos 7) | CACAGTCTGAAAGAAAACAG | 695 | CACAGUCUGAAAGAAAACAG | 1195 |
| | Exon 3 SD (pos 4) | TTACCATGGCCATCAGCACG | 696 | UUACCAUGGCCAUCAGCACG | 1196 |
| | Exon 1 SD (pos 8) | CCACTCACCTGCTCTACCCC | 690 | CCACUCACCUGCUCUACCCC | 1190 |
| CISH | Exon 1 STOP | TCTGCGTTCAGGGGTAAGCG | 697 | UCUGCGUUCAGGGGUAAGCG | 1197 |
| | Exon 1 SD | GCGCTTACCCCTGAACGCAG | 698 | GCGCUUACCCCUGAACGCAG | 1198 |
| | Exon 2 STOP 2 | GACTGGGCAGCGGCCCCTGT | 699 | GACUGGGCAGCGGCCCCUGU | 1199 |
| | Exon 2 STOP 1 | GGACTGGGCAGCGCGCCCTG | 700 | GGACUGGGCAGCGCGCCCUG | 1200 |
| | Exon 2 STOP 3 | GTCATGCAGCCCTTGCCTGC | 701 | GUCAUGCAGCCCUUGCCUGC | 1201 |
| | Exon 2 STOP 4 | TCATGCAGCCCTTGCCTGCT | 702 | UCAUGCAGCCCUUGCCUGCU | 1202 |
| | Exon 2 STOP 5 | CATGCAGCCCTTGCCTGCTG | 703 | CAUGCAGCCCUUGCCUGCUG | 1203 |
| | Exon 2 SD 1 | CTCACCAGATTCCCGAAGGT | 704 | CUCACCAGAUUCCCGAAGGU | 1204 |
| | Exon 2 SD 2 | CAGACTCACCAGATTCCCGA | 705 | CAGACUCACCAGAUUCCCGA | 1205 |

TABLE 4A-continued

| | gRNAs: Splice Site and STOP Codons | | | | |
|---|---|---|---|---|---|
| Gene | Description | Targeting sequence | SEQ ID NO: | gRNA Spacer Sequence | SEQ ID NO: |
| | Exon 3 SA 1 (pos 4) | AGCCTAGGCAAGTGCAGAGG | 706 | AGCCUAGGCAAGUGCAGAGG | 1206 |
| | Exon 3 SA 2 (pos 5) | CAGCCTAGGCAAGTGCAGAG | 707 | CAGCCUAGGCAAGUGCAGAG | 1207 |
| | Exon 3 SA 3 (pos 7) | ACCAGCCTAGGCAAGTGCAG | 708 | ACCAGCCUAGGCAAGUGCAG | 1208 |
| | Exon 3 STOP 1 (pos 8) | TGGAACCCCAATACCAGCCT | 709 | UGGAACCCCAAUACCAGCCU | 1209 |
| | Exon 3 STOP 2 (pos 7) | CACCTGCAGAAGATGCCAGA | 710 | CACCUGCAGAAGAUGCCAGA | 1210 |
| ACAT1 | Exon 1 SD 1 (pos 7) | CGCTCACCTGCACCAGCCTC | 711 | CGCUCACCUGCACCAGCCUC | 1211 |
| | Exon 3 SA (pos 5) | CTTCCTGGCAAGACACAAGA | 712 | CUUCCUGGCAAGACACAAGA | 1212 |
| | Exon 3 STOP (pos 5) | AATTCAGGGAGCCATTGAAA | 713 | AAUUCAGGGAGCCAUUGAAA | 1213 |
| | Exon 3 SD (pos 8) | CTACTGACCTGCCTTTTCAA | 714 | CUACUGACCUGCCUUUUCAA | 1214 |
| | Exon 5 STOP (pos 7) | GCCTCTCAAAGTCTTATGTG | 715 | GCCUCUCAAAGUCUUAUGUG | 1215 |
| | Exon 7 STOP (pos 4) | TTCCCATGCTGCTTTACTTC | 716 | UUCCCAUGCUGCUUUACUUC | 1216 |
| | Exon 8 STOP (pos 8) | TTTAGGTCAACCAGATGTAG | 717 | UUUAGGUCAACCAGAUGUAG | 1217 |
| | Exon 9 SA (pos 9) | TGTGCCTGAAAGCAAAAATG | 718 | UGUGCCUGAAAGCAAAAAUG | 1218 |
| | Exon 9 SD (pos 4) | TTACCTACTATTCTTGCCAG | 719 | UUACCUACUAUUCUUGCCAG | 1219 |
| | Exon 10 SA (pos 6) | AAATGCTGTTTAAAAAAAGG | 720 | AAAUGCUGUUUAAAAAAAGG | 1220 |
| | Exon 11 STOP (pos 4) | CCCCAAAAAGTGAATATCAA | 721 | CCCCAAAAAGUGAAUAUCAA | 1221 |
| Cyp11a1 | Exon 1 STOP 1 (pos 4) | GTCCAGAATTTCCAGAAGTA | 722 | GUCCAGAAUUUCCAGAAGUA | 1222 |
| | Exon 2 SA 1 (pos 4) | TCCCTGGAGGGGTGGGGGAG | 723 | UCCCUGGAGGGGUGGGGGAG | 1223 |
| | Exon 2 SD 1 (pos 4) | TCACTTCAACAGGACTCCTA | 724 | UCACUUCAACAGGACUCCUA | 1224 |
| | Exon 3 SD 1 (pos 6) | CCTTACACTCAAAGGCAAAG | 725 | CCUUACACUCAAAGGCAAAG | 1225 |
| | Exon 4 SA (pos 5) | ATGGCTGCAGGGAGAGGAAG | 726 | AUGGCUGCAGGGAGAGGAAG | 1226 |
| | Exon 4 STOP 1 (pos 8) | GGAGCGCCAGGGGATGCTGG | 727 | GGAGCGCCAGGGGAUGCUGG | 1227 |
| | Exon 4 STOP 2 (pos 8) | TCACGTCCCATGCAGCCACA | 728 | UCACGUCCCAUGCAGCCACA | 1228 |
| | Exon 6 SA (pos 8) | TGGACGTCTGGTGGGGAGTA | 729 | UGGACGUCUGGUGGGGAGUA | 1229 |
| | Exon 8 STOP 1 (pos 6) | ACTCACATTGATGAGGAAGA | 730 | ACUCACAUUGAUGAGGAAGA | 1230 |
| | Exon 9 SA (pos 7) | CAGCATCTGAGAAAGGCAGA | 731 | CAGCAUCUGAGAAAGGCAGA | 1231 |
| | Exon 9 STOP 1 (pos 5) | AATCCAACACCTCAGCGATG | 732 | AAUCCAACACCUCAGCGAUG | 1232 |
| | Exon 9 STOP 2 (pos 4) | ATCCAACACCTCAGCGATGT | 733 | AUCCAACACCUCAGCGAUGU | 1233 |
| GATA3 | Exon 1 STOP 1 (pos 8) | CGCGGCGCAGTACCCGCTGC | 734 | CGCGGCGCAGUACCCGCUGC | 1234 |
| | Exon 1 SD 1 (pos 7) | CACTCACCGTGGTGGGTCGG | 735 | CACUCACCGUGGUGGGUCGG | 1235 |
| | Exon 1 SD 2 (pos 6) | ACTCACCGTGGTGGGTCGGA | 736 | ACUCACCGUGGUGGGUCGGA | 1236 |
| | Exon 2 SA 1 (pos 8) | TGGCTCCCTGTGGGGCAACG | 737 | UGGCUCCCUGUGGGGCAACG | 1237 |
| | Exon 2 STOP 2 (pos 5) | GATTCCAGGGGGAGGCGGTG | 738 | GAUUCCAGGGGGAGGCGGUG | 1238 |
| | Exon 2 SD 1 (pos 8) | GCTCCTACCTGTGCTGGACC | 739 | GCUCCUACCUGUGCUGGACC | 1239 |
| | Exon 3 STOP 1 (pos 7) | TCGCCGCCACAGTGGGGTCG | 740 | UCGCCGCCACAGUGGGGUCG | 1240 |
| | Exon 4 SA (pos 5) | CAGACTGAGAGTGGGGAGAG | 741 | CAGACUGAGAGUGGGGAGAG | 1241 |
| | Exon 4 STOP 1 (pos 7) | CCTCCTCCAGAGTGTGGTTG | 742 | CCUCCUCCAGAGUGUGGUUG | 1242 |
| NR4A1 | Exon 1 STOP 1 (pos 8) | AGCCATCCCAGGGAGAGAGC | 743 | AGCCAUCCCAGGGAGAGAGC | 1243 |
| | Exon 1 STOP 2 (pos 7) | GCCATCCCAGGGAGAGAGCT | 744 | GCCAUCCCAGGGAGAGAGCU | 1244 |
| | Exon 1 STOP 3 (pos 6) | CCATCCCAGGGAGAGAGCTG | 745 | CCAUCCCAGGGAGAGAGCUG | 1245 |
| | Exon 1 STOP 4 (pos 5) | CTCACAGGCCACCCACCAGC | 746 | CUCACAGGCCACCCACCAGC | 1246 |
| | Exon 2 STOP 1 (pos 8) | CCGCTTCCAGAAGTGCCTGG | 747 | CCGCUUCCAGAAGUGCCUGG | 1247 |
| | Exon 2 STOP 2 (pos 5) | CTTCCAGAAGTGCCTGGCGG | 748 | CUUCCAGAAGUGCCUGGCGG | 1248 |
| | Exon 3 SA 1 (pos 5) | ACAACTGCAAAGGAATGGGT | 749 | ACAACUGCAAAGGAAUGGGU | 1249 |
| | Exon 3 SA 2 (pos 4) | CAACTGCAAAGGAATGGGTA | 750 | CAACUGCAAAGGAAUGGGUA | 1250 |
| | Exon 4 SA (pos 4) | GAACTAGGAAGACGGTCCAG | 751 | GAACUAGGAAGACGGUCCAG | 1251 |
| | Exon 4 STOP 1 (pos 8) | GGCTGACCAGGACCTGTTGC | 752 | GGCUGACCAGGACCUGUUGC | 1252 |
| | Exon 4 SD 1 (pos 5) | CTCACCTGTACGCCAGGCGG | 753 | CUCACCUGUACGCCAGGCGG | 1253 |
| | Exon 4 SD 2 (pos 8) | GCTCTCACCTGTACGCCAGG | 754 | GCUCUCACCUGUACGCCAGG | 1254 |
| | Exon 5 SA (pos 8) | CTTAGACCTGGCAGGCAGAT | 755 | CUUAGACCUGGCAGGCAGAU | 1255 |
| | Exon 5 STOP 1 (pos 5) | CAATCCAGTCCCCGAAGCCA | 756 | CAAUCCAGUCCCCGAAGCCA | 1256 |
| | Exon 5 STOP 2 (pos 4) | AATCCAGTCCCCGAAGCCAC | 757 | AAUCCAGUCCCCGAAGCCAC | 1257 |
| | Exon 5 SD 1 (pos 6) | ACTCACCGGTGATGAGGACA | 758 | ACUCACCGGUGAUGAGGACA | 1258 |
| | Exon 5 SD 2 (pos 5) | CTCACCGGTGATGAGGACAA | 759 | CUCACCGGUGAUGAGGACAA | 1259 |
| | Exon 6 SA (pos 6) | CCGGTCTGCGGGAAGGGTAC | 760 | CCGGUCUGCGGGAAGGGUAC | 1260 |
| | Exon 6 STOP 1 (pos 8) | TGGGCTGCAGGAGCCGCGGC | 761 | UGGGCUGCAGGAGCCGCGGC | 1261 |
| NR4A2 | Exon 1 STOP 1 (pos 7) | TTGTACCAAATGCCCCTGTC | 762 | UUGUACCAAAUGCCCCUGUC | 1262 |
| | Exon 1 STOP 2 (pos 8) | CGGACAGCAGTCCTCCATTA | 763 | CGGACAGCAGUCCUCCAUUA | 1263 |
| | Exon 1 STOP 3 (pos 6) | AGGTGCAGCACAGCCCCATG | 764 | AGGUGCAGCACAGCCCCAUG | 1264 |
| | Exon 1 STOP 4 (pos 5) | GGTGCAGCACAGCCCCATGT | 765 | GGUGCAGCACAGCCCCAUGU | 1265 |
| | Exon 1 STOP 5 (pos 7) | AGTTGCCAGATGCGCTTCGA | 766 | AGUUGCCAGAUGCGCUUCGA | 1266 |
| | Exon 1 STOP 6 (pos 6) | GTTGCCAGATGCGCTTCGAC | 767 | GUUGCCAGAUGCGCUUCGAC | 1267 |
| | Exon 1 STOP 7 (pos 5) | GTCTCAGCTGCTCGACACGC | 768 | GUCUCAGCUGCUCGACACGC | 1268 |
| | Exon 3 SD (pos 7) | TTCTTACCCTGGAATAGTCC | 769 | UUCUUACCCUGGAAUAGUCC | 1269 |
| | Exon 4 SD (pos 5) | ATTACCTGTATGCTAATCGA | 770 | AUUACCUGUAUGCUAAUCGA | 1270 |
| | Exon 5 SD 1 (pos 4) | TTGCAATGCGTTCGTGGCTT | 771 | UUGCAAUGCGUUCGUGGCUU | 1271 |
| | Exon 5 SD (pos 6) | ACTGACCTGTGACCATAGCC | 772 | ACUGACCUGUGACCAUAGCC | 1272 |
| NR4A3 | Exon 2 SA (pos 4) | TATCTGCAGGGACAGAGAAA | 773 | UAUCUGCAGGGACAGAGAAA | 1273 |
| | Exon 2 STOP 1 (pos 8) | TGCGGCGCAGACATACAGCT | 774 | UGCGGCGCAGACAUACAGCU | 1274 |
| | Exon 2 STOP 2 (pos 6) | CCCCGCAGGCGGGGGCGTTA | 775 | CCCCGCAGGCGGGGGCGUUA | 1275 |

TABLE 4A-continued qRNAs: Splice Site and STOP Codons

| Gene | Description | Targeting sequence | SEQ ID NO: | gRNA Spacer Sequence | SEQ ID NO: |
|---|---|---|---|---|---|
| | Exon 3 STOP 1 (pos 4) | TTTCAGAAGTGTCTCAGTGT | 776 | UUUCAGAAGUGUCUCAGUGU | 1276 |
| | Exon 5 SD (pos 5) | ATTACCTGATGGAAAGTCTG | 777 | AUUACCUGAUGGAAAGUCUG | 1277 |
| | Exon 6 STOP 1 (pos 4) | CTTCAGTGCCTTCGTGGATT | 778 | CUUCAGUGCCUUCGUGGAUU | 1278 |
| | Exon 7 SA (pos 4) | TTTCTGCAGAGGGATAGAGA | 779 | UUUCUGCAGAGGGAUAGAGA | 1279 |
| | Exon 7 STOP 1 (pos 8) | AGACCACCAGAGTAAGGGAC | 780 | AGACCACCAGAGUAAGGGAC | 1280 |
| MCJ | Exon 1 STOP (pos 6) | ACTTGCAGCCCTCGGCCAAA | 781 | ACUUGCAGCCCUCGGCCAAA | 1281 |
| FAS | Exon 1 SD (pos 9) | AGGGCTCACCAGAGGTAGGA | 782 | AGGGCUCACCAGAGGUAGGA | 1282 |
| | Exon 3 SA (pos 6) | TTCACCTGCCCAAGGAAAAA | 783 | UUCACCUGCCCAAGGAAAAA | 1283 |
| | Exon 4 SA (pos 7) | CTAAGCCTAGAAAATCAGTT | 784 | CUAAGCCUAGAAAAUCAGUU | 1284 |
| | Exon 5 SA (pos 5) | ACATCTAGAAAAAAAAATAC | 785 | ACAUCUAGAAAAAAAAAUAC | 1285 |
| | Exon 5 SD (pos 5) | ATTACCTTCCTCTTTGCACT | 786 | AUUACCUUCCUCUUUGCACU | 1286 |
| | Exon 6 SA (pos 5) | GATCCTGTAGGTTGGAACAT | 787 | GAUCCUGUAGGUUGGAACAU | 1287 |
| | Exon 6 STOP 1 (pos 4) | AAGCCACCCCAAGTTAGATC | 788 | AAGCCACCCCAAGUUAGAUC | 1288 |
| | Exon 6 SD (pos 7) | AACTTACCCCAAACAATTAG | 789 | AACUUACCCCAAACAAUUAG | 1289 |
| | Exon 7 SD (pos 8) | ATACCTACAGGATTTAAAGT | 790 | AUACCUACAGGAUUUAAAGU | 1290 |
| | Exon 8 SA (pos 8) | GTTTCCTAGAAAGCAAAAAA | 791 | GUUUCCUAGAAAGCAAAAAA | 1291 |
| | Exon 9 STOP 1 (pos 6) | AAGTTCAACTGCTTCGTAAT | 792 | AAGUUCAACUGCUUCGUAAU | 1292 |
| | Exon 9 STOP (pos 5) | AATTCAGACTATCATCCTCA | 793 | AAUUCAGACUAUCAUCCUCA | 1293 |
| SELPG/ | Exon1 STOP 1 (pos 6) | GCTTGCAGCTGTGGGACACC | 794 | GCUUGCAGCUGUGGGACACC | 1294 |
| PSGL1 | Exon1 STOP 2 (pos 8) | GACCACTCAACCAGTGCCCA | 795 | GACCACUCAACCAGUGCCCA | 1295 |
| | Exon1 STOP 3 (pos 8) | GGAGGCACAGACCACTCCAC | 796 | GGAGGCACAGACCACUCCAC | 1296 |
| | Exon1 STOP 4 (pos 5) | GGCACAGACAACTCGACTGA | 797 | GGCACAGACAACUCGACUGA | 1297 |
| | Exon1 STOP 5 (pos 8) | GGAGGCACAGACCACTCCAC | 796 | GGAGGCACAGACCACUCCAC | 1296 |
| | Exon1 STOP 6 (pos 4) | GCACAGACCACTCAACCCAC | 798 | GCACAGACCACUCAACCCAC | 1298 |
| | Exon1 STOP 7 (pos 8) | GACCACTCAACCCACAGGCC | 799 | GACCACUCAACCCACAGGCC | 1299 |
| | Exon1 STOP 8 (pos 8) | GACCACTCAAACCACAGCCA | 800 | GACCACUCAAACCACAGCCA | 1300 |
| | Exon1 STOP 9 (pos 8) | GACCACTCAACCCACAGCCA | 801 | GACCACUCAACCCACAGCCA | 1301 |
| | Exon1 STOP 10 (pos 8) | GGAGGCACAGACCACTCCAC | 796 | GGAGGCACAGACCACUCCAC | 1296 |
| | Exon1 STOP 11 (pos 8) | GACCACTCAACCAGCAGCCA | 802 | GACCACUCAACCAGCAGCCA | 1302 |

TABLE 4B qRNAs: Splice Site and STOP Codons

| Gene | gRNA Name | gRNA target | SEQ ID NO: | Orien- tatation | Target Bases(s) | Predicted Outcome |
|---|---|---|---|---|---|---|
| PDCD1 | Ex. 1 SD | CACCTACCTAAGAACCATCC | 202 | Antisense | C7 | Splice donor disruption. GT→AT |
| PDCD1 | Ex. 2 SA | GGAGTCTGAGAGATGGAGAG | 393 | Antisense | C6 | Splice acceptor disruption. AG→AA |
| PDCD1 | Ex. 3 SA | TTCTCTCTGGAAGGGCACAA | 404 | Antisense | C7 | Splice acceptor disruption. AG→AA |
| PDCD1 | Ex. 3 SD | GACGTTACCTCGTGCGGCCC | 400 | Antisense | C8 | Splice donor disruption. GT→AT |
| PDCD1 | Ex. 4 SA | CCTGCAGAGAAACACACTTG | 1303 | Antisense | C2 | Splice acceptor disruption. AG→AA |
| PDCD1 | Ex. 2 pmSTOP | GGGGTTCCAGGGCCCTGTCTG | 203 | Antisense | C7, C8 | pmSTOP induction: TGG (Trp)→ TAG, TGA, TAA |
| PDCD1 | Ex. 3 pmSTOP_1 | CAGTTCCAAACCCTGGTGGT | 397 | Sense | C7 | pmSTOP induction: CAA (Gln)→ TAA |
| PDCD1 | Ex. 3 pmSTOP_2 | GGACCCAGACTAGCAGCACC | 399 | Antisense | C5, C5 | pmSTOP induction: TGG (Trp)→ TAG, TGA, TAA |
| TRAC | Ex. 1 SD | CTTACCTGGGCTGGGGAAGA | 315 | Antisense | C5 | Splice donor disruption. GT→AT |
| TRAC | Ex. 3 SA | TTCGTATCTGTAAAACCAAG | 316 | Antisense | C8 | Splice acceptor disruption. AG→AA |
| TRAC | Ex. 3 pmSTOP_1 | TTTCCAAAACCTGTCAGTGAT | 317 | Sense | C4 | pmSTOP induction: CAA (Gln)→ TAA |

TABLE 4B-continued gRNAs: Splice Site and STOP Codons

| Gene | gRNA Name | gRNA target | SEQ ID NO: | Orien-tation | Target Bases(s) | Predicted Outcome |
|------|-----------|-------------|------------|--------------|------------------|-------------------|
| TRAC | Ex. 3 pmSTOP_2 | TTCAAAACCTGTCAGTGATT | 318 | Sense | C3 | pmSTOP induction: CAA (Gln) → TAA |

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer). The PAM sequence is essential for target binding, but the exact sequence depends on a type of Cas protein. The PAM sequence can be any PAM sequence known in the art. Suitable PAM sequences include, but are not limited to, NGG, NGA, NGC, NGN, NGT, NGTT, NGCG, NGAG, NGAN, NGNG, NGCN, NGCG, NGTN, NNGRRT, NNNRRT, NNGRR(N), TTTV, TYCV, TYCV, TATV, NNNNGATT, NNAGAAW, or NAAAAC. Y is a pyrimidine; N is any nucleotide base; W is A or T.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities.

For example, typically Cas9 proteins, such as Cas9 from S. pyogenes (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length.

In some embodiments, the PAM is an "NRN" PAM where the "N" in "NRN" is adenine (A), thymine (T), guanine (G), or cytosine (C), and the R is adenine (A) or guanine (G); or the PAM is an "NYN" PAM, wherein the "N" in NYN is adenine (A), thymine (T), guanine (G), or cytosine (C), and the Y is cytidine (C) or thymine (T), for example, as described in R. T. Walton et al., 2020, Science, 10.1126/science.aba8853 (2020), the entire contents of which are incorporated herein by reference.

Several PAM variants are described in Table 5 below.

TABLE 5

Cas9 proteins and corresponding PAM sequences

| Variant | PAM |
|---------|-----|
| spCas9 | NGG |
| spCas9-VRQR | NGA |
| spCas9-VRER | NGCG |

TABLE 5-continued

Cas9 proteins and corresponding PAM sequences

| Variant | PAM |
|---------|-----|
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| spCas9-MQKFRAER | NGC |
| Cpf1 | 5' (TTTV) |
| SpyMac | 5'-NAA-3' |

In some embodiments, the PAM is NGC. In some embodiments, the NGC PAM is recognized by a Cas9 variant. In some embodiments, the NGC PAM variant includes one or more amino acid substitutions selected from D1135M, S1136Q, G1218K, E1219F, A1322R, D1332A, R1335E, and T1337R (collectively termed "MQKFRAER").

In some embodiments, the PAM is NGT. In some embodiments, the NGT PAM is recognized by a Cas9 variant. In some embodiments, the NGT PAM variant is generated through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Tables 6A and 6B below.

TABLE 6A

NGT PAM Variant Mutations at residues 1219, 1335, 1337, 1218

| Variant | E1219V | R1335Q | T1337 | G1218 |
|---------|--------|--------|-------|-------|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |

TABLE 6A-continued

| NGT PAM Variant Mutations at residues 1219, 1335, 1337, 1218 | | | |
|---|---|---|---|
| Variant | E1219V | R1335Q | T1337 | G1218 |
|---|---|---|---|---|
| 21 | L | A | W | |
| 22 | L | A | F | |
| 23 | L | A | Y | |
| 24 | I | A | W | |
| 25 | I | A | F | |
| 26 | I | A | Y | |

TABLE 6B

| NGT PAM Variant Mutations at residues 1135, 1136, 1218, 1219, and 1335 | | | | |
|---|---|---|---|---|
| Variant | D1135L | S1136R | G1218S | E1219V | R1335Q |
|---|---|---|---|---|---|
| 27 | G | | | | |
| 28 | V | | | | |
| 29 | I | | | | |
| 30 | | A | | | |
| 31 | | W | | | |
| 32 | | H | | | |
| 33 | | K | | | |
| 34 | | | K | | |
| 35 | | | R | | |
| 36 | | | Q | | |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |

TABLE 6B-continued

| NGT PAM Variant Mutations at residues 1135, 1136, 1218, 1219, and 1335 | | | | |
|---|---|---|---|---|
| Variant | D1135L | S1136R | G1218S | E1219V | R1335Q |
|---|---|---|---|---|---|
| 46 | | | | T | |
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

In some embodiments, the NGT PAM variant is selected from variant 5, 7, 28, 31, or 36 in Table 6A and Table 6B. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 7 below.

TABLE 7

| NGT PAM Variant Mutations at residues 1219, 1335, 1337, and 1218 | | | |
|---|---|---|---|
| Variant | E1219V | R1335Q | T1337 | G1218 |
|---|---|---|---|---|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, the NGT PAM is selected from the variants provided in Table 8 below.

TABLE 8

| NGT PAM variants | | | | | | | |
|---|---|---|---|---|---|---|---|
| | NGTN variant | D1135 | S1136 | G1218 | E1219 | A1322R | R1335 | T1337 |
|---|---|---|---|---|---|---|---|---|
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

In some embodiments the NGTN variant is variant 1. In some embodiments, the NGTN variant is variant 2. In some embodiments, the NGTN variant is variant 3. In some embodiments, the NGTN variant is variant 4. In some embodiments, the NGTN variant is variant 5. In some embodiments, the NGTN variant is variant 6.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence.

In some embodiments, the SpCas9 domain comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1135E, R1335Q, and T1337R mutation, or a corresponding mutation in any of the amino acid sequences provided herein. In some embodiments, the SpCas9 domain comprises a D1135E, a R1335Q, and a T1337R mutation, or corresponding mutations in any of the amino acid sequences provided herein. In some embodiments, the SpCas9 domain comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1135V, a R1335Q, and a T1337R mutation, or a corresponding mutation in any of the amino acid sequences provided herein. In some embodiments, the SpCas9 domain comprises a D1135V, a R1335Q, and a T1337R mutation, or corresponding mutations in any of the amino acid sequences provided herein. In some embodiments, the SpCas9 domain comprises one or more of a D1135X, a G1218X, a R1335X, and a T1337X mutation, or a corresponding mutation in any of the amino acid sequences provided herein, wherein X is any amino acid. In some embodiments, the SpCas9 domain comprises one or more of a D1135V, a G1218R, a R1335Q, and a T1337R mutation, or a corresponding mutation in any of the amino acid sequences provided herein. In some embodiments, the SpCas9 domain comprises a D1135V, a G1218R, a R1335Q, and a T1337R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4kb coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of *S. thermophilus* (5'-NNAGAA for CRISPR1 and 5'-NGGNG for CRISPR3) and *Neisseria meningitidis* (5'-NNNNGATT) can also be found adjacent to a target gene.

In some embodiments, for a *S. pyogenes* system, a target gene sequence can precede (i.e., be 5' to) a 5'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2,3,4,5,6,7, 8,9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

The amino acid sequence of an exemplary PAM-binding SpCas9 is as follows:

```
MDKKYSIGLDIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNE

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA
```

-continued

```
HLFDDKVMKQLKRRRYTGWGRLSRKLINGIRDKQSGKTILDFLKSDGFANRNFMQLIHDDSLTE

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNTVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
```

The amino acid sequence of an exemplary PAM-binding SpCas9n is as follows:

```
MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPALKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLEVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
```

The amino acid sequence of an exemplary PAM-binding SpEQR Cas9 is as follows:

```
MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESVLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNE

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFESPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLHVEQHKHYLDEIIEQISEFSKRV

ILADANLDKVLSAYNKHRDKPIREQAENIIHLFTLTNLGAPAAFKYFDTTIDRKQYRSTKEVLD

ATLIHQSITGLYETRIDLSQLGGD
```

In the above sequence, residues E1135, Q1335, and R1337, which can be mutated from D1135, R1335, and T1337 to yield a SpEQR Cas9, are underlined and in bold.

The amino acid sequence of an exemplary PAM-binding SpVQR Cas9 is as follows:

```
MDKKYSIGLAIGTNSVGWAVITDEYKVPSKKFKVLGNTDRHSTKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNE

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR
```

-continued

```
LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGEVSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKQYRSTKEVLD

ATLIHQSITGLYETRIDLSQLGGD
```

In the above sequence, residues V1135, Q1335, and R1337, which can be mutated from D1135, R1335, and T1337 to yield a SpVQR Cas9, are underlined and in bold.

The amino acid sequence of an exemplary PAM-binding SpVRER Cas9 is as follows:

```
MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNE

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFVSPTVAYSVLVVAKVEKG

KSKKLKSVKELLGITIMERSSFEKNPIDFLEAKGYKEVKKDLIIKLPKYSLFELENGRKRMLAS

ARELQKGNELALPSKYVNFLILASHYEKLKGSPEDNEQKQLHVEQHKHYLDEIIEQISEFSKRV

ILADANLDKVLSAYNKHRDKPIREQAENIIHLETLTNLGAPAAFKYFDTTIDRKEYRSTKEVLD

ATLIHQSITGLYETRIDLSQLGGD.
```

In the above sequence, residues V1135, R1218, Q1335, and R1337, which can be mutated from D1135, G1218, R1335, and T1337 to yield a SpVRER Cas9, are underlined and in bold.

In some embodiments, engineered SpCas9 variants are capable of recognizing protospacer adjacent motif (PAM) sequences flanked by a 3' H (non-G PAM) (see Tables 3A-3D). In some embodiments, the SpCas9 variants recognize NRNH PAMs (where R is A or G and H is A, C or T). In some embodiments, the non-G PAM is NRRH, NRTH, or NRCH (see e.g., Miller, S. M., et al. Continuous evolution of SpCas9 variants compatible with non-G PAMs, Nat. Biotechnol. (2020), the contents of which is incorporated herein by reference in its entirety).

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a Spy- MacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMac-Cas9 domain, the SpCas9d domain, or the SpCas9n domain can bind to a nucleic acid sequence having a NAA PAM sequence.

The sequence of an exemplary Cas9 A homolog of Spy Cas9 in *Streptococcus macacae* with native 5'-NAAN-3' PAM specificity is known in the art and described, for example, by Jakimo et al., (www.biorxiv.org/content/biorxiv/early/2018/09/27/429654.full.pdf), and is provided below.

DNA). In some embodiments, when a variant Cas9 protein harbors W476A and WI 126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated SpyMacCas9
```
MDKKYSLGLDLGTNSVGWAVLTDDYKVPSKKHKVLGNTDRHSIKKNLLGALLEGSGETAE

ATRLKRTARRRYTRRKNRICYLQEIFSNEMAKVDDSFFHRLEESFLVEEDKKHERHPIFG

NIVDEVAYHEKYPTIYHLRKKLADSTDKADLRLIYLALAHMIKFRGHFLIEGDLNPDNSD

VDKLFTQLVQIYNQLFEENPINASRVDAKAILSARLSKSRRLENLIAQLPGEKRNGLFGN

LIALSLGLTPNFKSNFDLAEDAKLQLSKDTYDDDLDNLLAQIGDQYADLFLAAKNLSDAI

LLSDILRVNSEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELH

AILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNASLGAYHDLLKI

IKDKDFLDNEENEDILEDIVLTLTLFEDRGMIEERLKTYAHLFDDKVMKQLKRRRYTGWG

RLSRKLINGIRDKQSGKTILDELKSDGFANRNFMQLIHDDSLTFKEDIQKAQVSGQGHSL

HEQIANLAGSPAIKKGILQTVKIVDELVKVMGHKPENIVIEMARENQTTQKGQKNSRERM

KRIEEGIKELGSQILKEHPVENTQLQNEKLYLYYLQNGRDMYVDQELDINRLSDYDVDHI

VPQSFTKDDSIDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIREVKVITLKSK

LVSDFRKDFQFYKVREINNYHHAHDAYLNAVVGTALIKKYPKLESEFVYGDYKVYDVRKM

IAKSEQEIGKATAKYFFYSNIMNFFKTEITLANGEIKKRPLIETNGETEIVWDKGRDHA

TVRKVLSMPQVNIVKKTEIQTVGQNGGLFDDNPKSPLEVTPSKLVPLKKELNPKKYGGYQ

KPTTAYPVLLITDTKQLIPISVMNKKQFEQNPVKFLRDRGYQQVGKNDFIKLPKYTLVDI

GDGIKRLWASSKEIHKGNQLVVSKKSQILLYHAHHLDSDLSNDYLQNHNQQFDVLFNEII

SFSKKCKLGKEHIQKIENVYSNKKNSASIEELAESFIKLLGFTQLGATSPFNFLGVKLNQ

KQYKGKKDYILPCTEGTLIRQSITGLYETRVDLSKIGED.
```

In some embodiments, a variant Cas9 protein harbors, H840A, P475A, W476A, N477A, D1125A, W1126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Klein-stiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); R. T. Walton et al. "Unconstrained genome targeting with near-PAMless engineered CRISPR-Cas9 variants" *Science* 10.1126/science.aba8853 (2020); Hu et al. "Evolved Cas9 variants with broad PAM compatibility and high DNA specificity," *Nature,* 2018 Apr. 5, 556(7699), 57-63; Miller et al., "Continuous evolution of SpCas9 variants compatible with non-G PAMs" *Nat. Biotechnol.,* 2020 April; 38(4):471-481; the entire contents of each are hereby incorporated by reference.

Cas9 Domains with Reduced Exclusivity

Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

Fusion Proteins with Internal Insertions

Provided herein are fusion proteins comprising a heterologous polypeptide fused to a nucleic acid programmable nucleic acid binding protein, for example, a napDNAbp. A heterologous polypeptide can be a polypeptide that is not found in the native or wild-type napDNAbp polypeptide sequence. The heterologous polypeptide can be fused to the napDNAbp at a C-terminal end of the napDNAbp, an N-terminal end of the napDNAbp, or inserted at an internal location of the napDNAbp. In some embodiments, the heterologous polypeptide is inserted at an internal location of the napDNAbp. In some embodiments, the heterologous polypeptide is a deaminase or a functional fragment thereof. For example, a fusion protein can comprise a deaminase flanked by an N-terminal fragment and a C-terminal fragment of a Cas9 or Cas12 (e.g., Cas12b/C2c1), polypeptide. The deaminase in a fusion protein can be a cytidine deaminase. In some embodiments, the cytidine deaminase is an APOBEC deaminase (e.g., APOBEC1). The deaminase in a fusion protein can be an adenosine deaminase. In some embodiments, the adenosine deaminase is a TadA (e.g., TadA*7.10 or TadA*8). In some embodiments, the TadA is a TadA*8 or a TadA*9. TadA sequences (e.g., TadA7.10 or TadA*8) as described herein are suitable deaminases for the above-described fusion proteins.

In some embodiments, the fusion protein comprises the structure:

NH2-[N-terminal fragment of a napDNAbp]-[deaminase]-[C-terminal fragment of a napDNAbp]-COOH;

NH2-[N-terminal fragment of a Cas9]-[adenosine deaminase]-[C-terminal fragment of a Cas9]-COOH;

NH2-[N-terminal fragment of a Cas12]-[adenosine deaminase]-[C-terminal fragment of a Cas12]-COOH;

NH2-[N-terminal fragment of a Cas9]-[cytidine deaminase]-[C-terminal fragment of a Cas9]-COOH;

NH2-[N-terminal fragment of a Cas12]-[cytidine deaminase]-[C-terminal fragment of a Cas12]-COOH;

wherein each instance of "]-[" is an optional linker.

The deaminase can be a circular permutant deaminase. For example, the deaminase can be a circular permutant adenosine deaminase. In some embodiments, the deaminase is a circular permutant TadA, circularly permutated at amino acid residue 116 as numbered in the TadA reference sequence. In some embodiments, the deaminase is a circular permutant TadA, circularly permutated at amino acid residue 136 as numbered in the TadA reference sequence. In some embodiments, the deaminase is a circular permutant TadA, circularly permutated at amino acid residue 65 as numbered in the TadA reference sequence.

The fusion protein can comprise more than one deaminase. The fusion protein can comprise, for example, 1, 2, 3, 4, 5 or more deaminases. In some embodiments, the fusion protein comprises one deaminase. In some embodiments, the fusion protein comprises two deaminases. The two or more deaminases in a fusion protein can be an adenosine deaminase. cytidine deaminase, or a combination thereof. The two or more deaminases can be homodimers. The two or more deaminases can be heterodimers. The two or more deaminases can be inserted in tandem in the napDNAbp. In some embodiments, the two or more deaminases may not be in tandem in the napDNAbp.

In some embodiments, the napDNAbp in the fusion protein is a Cas9 polypeptide or a fragment thereof. The Cas9 polypeptide can be a variant Cas9 polypeptide. In some embodiments, the Cas9 polypeptide is a Cas9 nickase (nCas9) polypeptide or a fragment thereof. In some embodiments, the Cas9 polypeptide is a nuclease dead Cas9 (dCas9) polypeptide or a fragment thereof. The Cas9 polypeptide in a fusion protein can be a full-length Cas9 polypeptide. In some cases, the Cas9 polypeptide in a fusion protein may not be a full length Cas9 polypeptide. The Cas9 polypeptide can be truncated, for example, at a N-terminal or C-terminal end relative to a naturally-occurring Cas9 protein. The Cas9 polypeptide can be a circularly permuted Cas9 protein. The Cas9 polypeptide can be a fragment, a portion, or a domain of a Cas9 polypeptide, that is still capable of binding the target polynucleotide and a guide nucleic acid sequence.

In some embodiments, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or fragments or variants thereof.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas9 polypeptide.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to the Cas9 amino acid sequence set forth below (called the "Cas9 reference sequence" below): MDKKYSIGLDIGTNSVGWAVIT-DEYKVPSKKFKVLGNTDRHSIKKNLIGALLFDSGE-TAEATRL KRTARRRYTRRKNRICYLQEIFSNE-MAKVDDSFFHRLEESFLVEEDKKHERHPIFGNIVDEVAY-HEKYPTIYHLRKKLVDSTDKADLRLIYLALAH-MIKFRGHFLIEGDLNPDNSDVDKLFIQLVQTY NQL-FEENPINASGVDAKAILSARLSKSRRLENLIA-QLPGEKKNGLFGNLIALSLGLTPNFKSNF DLAED-AKLQLSKDTYDDDLDNLLAQIGDQYADLF-LAAKNLSDAILLSDILRVNTEITKAPLSAS MIKRYDE-HHQDLTLLKALVRQQLPEKYKEIFFDQSKNG-YAGYIDGGASQEEFYKFIKPILEKMD GTEELLVK-LNREDLLRKQRTFDNGSIPHQIHLGEL-HAILRRQEDFYPFLKDNREKIEKILTFRI PYYVG-PLARGNSRFAWMTRKSEETITPWNFEEVVDK-GASAQSFIERMTNFDKNLPNEKVLPKHS LLYEYF-TVYNELTKVKYVTEGMRKPAFLSGEQKKAIVDLL-FKTNRKVTVKQLKEDYFKKIECFD SVEISGVEDRF-NASLGTYHDLLKIIKDKDFLDNEENEDILEDI-VLTLTLFEDREMIEERLKTYA HLFDDKVMKQL-KRRRYTGWGRLSRKLINGIRDKQSGKTILD-FLKSDGFANRNFMQLIHDDSLTF KEDIQKAQ-VSGQGDSLHEHIANLAGSPAIKKGILQTVKV-VDELVKVMGRHKPENIVIEMARENQ TTQKGQKNSR-ERMKRIEEGIKELGSQILKEHPVENTQLQNEKLY-LYYLQNGRDMYVDQELDINR LSDYDVDHIVPQS-FLKDDSIDNKVLTRSDKNRGKSDNVPSEEVVKK-MKNYWRQLLNAKLITQRK FDNLTKAERGGLSEL-DKAGFIKRQLVETRQITKHVAQTLDSRMNTKY-DENDKLIREVKVITLKS KLVSDFRKDFQFYKVREIN-NYHHAHDAYLNAVVGTALIKKYPKLESEFVYGD-YKVYDVRKMIAK SEQEIGKATAKYFFYSNIMNFFK-TEITLANGEIRKRPLIETNGETGEIVWDKGRDFA-TVRKVLS MPQVNIVKKTEVQTGGFSKESILPKRN-SDKLIARKKDWDPKKYGGFDSPTVAYSVLVVAKVE-KG KSKKLKSVKELLGITIMERSSFEKNPIDFLEA-KGYKEVKKDLIIKLPKYSLFELENGRKRMLAS AGE-LQKGNELALPSKYVNFLYLASHYEKLKGSPED-NEQKQLFVEQHKHYLDEIIEQISEFSKRV ILAD-ANLDKVLSAYNKHRDKPIREQAENIIHLFTLTNL-GAPAAFKYFDTTIDRKRYTSTKEVLD ATLIHQSITG-LYETRIDLSQLGGD (SEQ ID NO: 223) (single underline: HNH domain; double underline: RuvC domain).

Fusion proteins comprising a heterologous catalytic domain flanked by N- and C-terminal fragments of a Cas9 polypeptide are also useful for base editing in the methods as described herein. Fusion proteins comprising Cas9 and one or more deaminase domains, e.g., adenosine deaminase, or comprising an adenosine deaminase domain flanked by Cas9 sequences are also useful for highly specific and efficient base editing of target sequences. In an embodiment, a chimeric Cas9 fusion protein contains a heterologous catalytic domain (e.g., adenosine deaminase, cytidine deaminase, or adenosine deaminase and cytidine deaminase) inserted within a Cas9 polypeptide. In some embodiments, the fusion protein comprises an adenosine deaminase domain and a cytidine deaminase domain inserted within a Cas9. In some embodiments, an adenosine deaminase is fused within a Cas9 and a cytidine deaminase is fused to the C-terminus. In some embodiments, an adenosine deaminase is fused within Cas9 and a cytidine deaminase fused to the N-terminus. In some embodiments, a cytidine deaminase is fused within Cas9 and an adenosine deaminase is fused to the C-terminus. In some embodiments, a cytidine deaminase is fused within Cas9 and an adenosine deaminase fused to the N-terminus.

Exemplary structures of a fusion protein with an adenosine deaminase and a cytidine deaminase and a Cas9 are provided as follows:

NH$_2$-[Cas9(adenosine deaminase)]-[cytidine deaminase]-COOH;

NH$_2$-[cytidine deaminase]-[Cas9(adenosine deaminase)]-COOH;

NH$_2$-[Cas9(cytidine deaminase)]-[adenosine deaminase]-COOH; or

NH$_2$-[adenosine deaminase]-[Cas9(cytidine deaminase)]-COOH.

In some embodiments, the "-" used in the general architecture above indicates the presence of an optional linker.

In various embodiments, the catalytic domain has DNA modifying activity (e.g., deaminase activity), such as adenosine deaminase activity. In some embodiments, the adenosine deaminase is a TadA (e.g., TadA*7.10). In some embodiments, the TadA is a TadA*8. In some embodiments, a TadA*8 is fused within Cas9 and a cytidine deaminase is fused to the C-terminus. In some embodiments, a TadA*8 is fused within Cas9 and a cytidine deaminase fused to the N-terminus. In some embodiments, a cytidine deaminase is fused within Cas9 and a TadA*8 is fused to the C-terminus. In some embodiments, a cytidine deaminase is fused within Cas9 and a TadA*8 fused to the N-terminus. Exemplary structures of a fusion protein with a TadA*8 and a cytidine deaminase and a Cas9 are provided as follows:

NH$_2$-[Cas9(TadA*8)]-[cytidine deaminase]-COOH;

NH$_2$-[cytidine deaminase]-[Cas9(TadA*8)]-COOH;

NH$_2$-[Cas9(cytidine deaminase)]-[TadA*8]-COOH; or

NH$_2$-[TadA*8]-[Cas9(cytidine deaminase)]-COOH.

In some embodiments, the "-" used in the general architecture above indicates the presence of an optional linker.

The heterologous polypeptide (e.g., deaminase) can be inserted in the napDNAbp (e.g., Cas9 or Cas12 (e.g., Cas12b/C2c1)) at a suitable location, for example, such that the napDNAbp retains its ability to bind the target polynucleotide and a guide nucleic acid. A deaminase (e.g., adenosine deaminase, cytidine deaminase, or adenosine deaminase and cytidine deaminase) can be inserted into a napDNAbp without compromising function of the deaminase (e.g., base editing activity) or the napDNAbp (e.g., ability to bind to target nucleic acid and guide nucleic acid). A deaminase (e.g., adenosine deaminase, cytidine deaminase, or adenosine deaminase and cytidine deaminase) can be inserted in the napDNAbp at, for example, a disordered region or a region comprising a high temperature factor or B-factor as shown by crystallographic studies. Regions of a protein that are less ordered, disordered, or unstructured, for example solvent exposed regions and loops, can be used for insertion without compromising structure or function. A deaminase (e.g., adenosine deaminase, cytidine deaminase, or adenosine deaminase and cytidine deaminase)can be inserted in the napDNAbp in a flexible loop region or a solvent-exposed region. In some embodiments, the deaminase (e.g., adenosine deaminase, cytidine deaminase, or adenosine deaminase and cytidine deaminase) is inserted in a flexible loop of the Cas9 or the Cas12b/C2c1 polypeptide.

In some embodiments, the insertion location of a deaminase (e.g., adenosine deaminase, cytidine deaminase, or adenosine deaminase and cytidine deaminase) is determined by B-factor analysis of the crystal structure of Cas9 polypeptide. In some embodiments, the deaminase (e.g., adenosine deaminase, cytidine deaminase, or adenosine deaminase and cytidine deaminase) is inserted in regions of the Cas9 polypeptide comprising higher than average B-factors (e.g., higher B factors compared to the total protein or the protein domain comprising the disordered region). B-factor or temperature factor can indicate the fluctuation of atoms from their average position (for example, as a result of temperature-dependent atomic vibrations or static disorder in a crystal lattice). A high B-factor (e.g., higher than average B-factor) for backbone atoms can be indicative of a region with relatively high local mobility. Such a region can be used for inserting a deaminase without compromising structure or function. A deaminase (e.g., adenosine deaminase, cytidine deaminase, or adenosine deaminase and cytidine deaminase) can be inserted at a location with a residue having a Cα atom with a B-factor that is 50%, 60%, 70%, 80%, 90%, 100%, 110%, 120%, 130%, 140%, 150%, 160%, 170%, 180%, 190%, 200%, or greater than 200% more than the average B-factor for the total protein. A deaminase (e.g., adenosine deaminase, cytidine deaminase, or adenosine deaminase and cytidine deaminase) can be inserted at a location with a residue having a Cα atom with a B-factor that is 50%, 60%, 70%, 80%, 90%, 100%, 110%, 120%, 130%, 140%, 150%, 160%, 170%, 180%, 190%,200% or greater than 200% more than the average B-factor for a Cas9 protein domain comprising the residue. Cas9 polypeptide positions comprising a higher than average B-factor can include, for example, residues 768, 792, 1052, 1015, 1022, 1026, 1029, 1067, 1040, 1054, 1068, 1246, 1247, and 1248 as numbered in the above Cas9 reference sequence. Cas9 polypeptide regions comprising a higher than average B-factor can include, for example, residues 792-872, 792-906, and 2-791 as numbered in the above Cas9 reference sequence.

A heterologous polypeptide (e.g., deaminase) can be inserted in the napDNAbp at an amino acid residue selected from the group consisting of 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. In some embodiments, the heterologous polypeptide is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in the above Cas9 reference sequence or corresponding amino acid positions thereof. In some embodiments, the heterologous polypeptide is inserted between amino acid positions 769-770, 792-793, 793-794, 1016-1017, 1023-1024, 1027-1028, 1030-1031, 1041-1042, 1053-1054, 1055-1056, 1068-1069, 1069-1070, 1248-1249, or 1249-1250 as numbered in the above Cas9 reference sequence or corresponding amino acid positions thereof. In some embodiments, the heterologous polypeptide replaces an amino acid residue selected from the group consisting of 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. It should be understood that the reference to the above Cas9 reference sequence with respect to insertion positions is for illustrative purposes. The insertions as discussed herein are not limited to the Cas9 polypeptide sequence of the above Cas9 reference sequence, but include insertion at corresponding locations in variant Cas9 polypeptides, for example a Cas9 nickase (nCas9), nuclease dead Cas9 (dCas9), a Cas9 variant lacking a nuclease domain, a truncated Cas9, or a Cas9 domain lacking partial or complete HNH domain.

A heterologous polypeptide (e.g., deaminase) can be inserted in the napDNAbp at an amino acid residue selected from the group consisting of: 768, 792, 1022, 1026, 1040, 1068, and 1247 as numbered in the above Cas9 reference sequence, or a corresponding amino acid residue in another Cas9 polypeptide. In some embodiments, the heterologous polypeptide is inserted between amino acid positions 768-769, 792-793, 1022-1023, 1026-1027, 1029-1030, 1040-1041, 1068-1069, or 1247-1248 as numbered in the above Cas9 reference sequence or corresponding amino acid positions thereof. In some embodiments, the heterologous polypeptide is inserted between amino acid positions 769-770, 793-794, 1023-1024, 1027-1028, 1030-1031, 1041-1042, 1069-1070, or 1248-1249 as numbered in the above Cas9 reference sequence or corresponding amino acid positions thereof. In some embodiments, the heterologous polypeptide replaces an amino acid residue selected from the group consisting of: 768, 792, 1022, 1026, 1040, 1068, and 1247 as numbered in the above Cas9 reference sequence, or a corresponding amino acid residue in another Cas9 polypeptide.

A heterologous polypeptide (e.g., deaminase) can be inserted in the napDNAbp at an amino acid residue as described herein, or a corresponding amino acid residue in another Cas9 polypeptide. In an embodiment, a heterologous polypeptide (e.g., deaminase) can be inserted in the napDNAbp at an amino acid residue selected from the group consisting of: 1002, 1003, 1025, 1052-1056, 1242-1247, 1061-1077, 943-947, 686-691, 569-578, 530-539, and 1060-1077 as numbered in the above Cas9 reference sequence, or a corresponding amino acid residue in another Cas9 polypeptide. The deaminase (e.g., adenosine deaminase, cytidine deaminase, or adenosine deaminase and cytidine deaminase) can be inserted at the N-terminus or the C-terminus of the residue or replace the residue. In some embodiments, the deaminase (e.g., adenosine deaminase, cytidine deaminase, or adenosine deaminase and cytidine deaminase) is inserted at the C-terminus of the residue.

In some embodiments, an adenosine deaminase (e.g., TadA) is inserted at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, an adenosine deaminase (e.g., TadA) is inserted in place of residues 792-872, 792-906, or 2-791 as numbered in the above Cas9 reference sequence, or a corresponding amino acid residue in another Cas9 polypeptide. In some embodiments, the adenosine deaminase is inserted at the N-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted at the C-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted to replace an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

In some embodiments, a cytidine deaminase (e.g., APOBEC1) is inserted at an amino acid residue selected from the group consisting of: 1016, 1023, 1029, 1040, 1069, and 1247 as numbered in the above Cas9 reference sequence, or a corresponding amino acid residue in another Cas9 polypeptide. In some embodiments, the cytidine deaminase is inserted at the N-terminus of an amino acid selected from the group consisting of: 1016, 1023, 1029, 1040, 1069, and 1247 as numbered in the above Cas9 reference sequence, or a corresponding amino acid residue in another Cas9 polypeptide. In some embodiments, the cytidine deaminase is inserted at the C-terminus of an amino acid selected from the group consisting of: 1016, 1023, 1029, 1040, 1069, and 1247 as numbered in the above Cas9 reference sequence, or a corresponding amino acid residue in another Cas9 polypeptide. In some embodiments, the cytidine deaminase is inserted to replace an amino acid selected from the group consisting of: 1016, 1023, 1029, 1040, 1069, and 1247 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 768 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 791 or is inserted at amino acid residue 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid 791, or is inserted to replace amino acid 792, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1016 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1022, or is inserted at amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1022 or is inserted at the N-terminus of amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1022 or is inserted at the C-terminus of amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1022, or is inserted to replace amino acid residue 1023, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1026, or is inserted at amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1026 or is inserted at the N-terminus of amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1026 or is inserted at the C-terminus of amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1026, or is inserted to replace amino acid residue 1029, as numbered in the above Cas9 reference sequence, or corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1040 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1052, or is inserted at amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1052 or is inserted at the N-terminus of amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1052 or is inserted at the C-terminus of amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1052, or is inserted to replace amino acid residue 1054, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1067, or is inserted at amino acid residue 1068, or is inserted at amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1067 or is inserted at the N-terminus of amino acid residue 1068 or is inserted at the N-terminus of amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1067 or is inserted at the C-terminus of amino acid residue 1068 or is inserted at the C-terminus of amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1067, or is inserted to replace amino acid residue 1068, or is inserted to replace amino acid residue 1069, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1246, or is inserted at amino acid residue 1247, or is inserted at amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1246 or is inserted at the N-terminus of amino acid residue 1247 or is inserted at the N-terminus of amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1246 or is inserted at the C-terminus of amino acid residue 1247 or is inserted at the C-terminus of amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1246, or is inserted to replace amino acid residue 1247, or is inserted to replace amino acid residue 1248, as numbered in the above Cas9 reference sequence, or a corresponding amino acid residue in another Cas9 polypeptide.

In some embodiments, a heterologous polypeptide (e.g., deaminase) is inserted in a flexible loop of a Cas9 polypeptide. The flexible loop portions can be selected from the group consisting of 530-537, 569-570, 686-691, 943-947, 1002-1025, 1052-1077, 1232-1247, or 1298-1300 as numbered in the above Cas9 reference sequence, or a corresponding amino acid residue in another Cas9 polypeptide. The flexible loop portions can be selected from the group consisting of: 1-529, 538-568, 580-685, 692-942, 948-1001, 1026-1051, 1078-1231, or 1248-1297 as numbered in the above Cas9 reference sequence, or a corresponding amino acid residue in another Cas9 polypeptide.

A heterologous polypeptide (e.g., adenine deaminase) can be inserted into a Cas9 polypeptide region corresponding to amino acid residues: 1017-1069, 1242-1247, 1052-1056, 1060-1077, 1002-1003, 943-947, 530-537, 568-579, 686-691, 1242-1247, 1298-1300, 1066-1077, 1052-1056, or 1060-1077 as numbered in the above Cas9 reference sequence, or a corresponding amino acid residue in another Cas9 polypeptide.

A heterologous polypeptide (e.g., adenine deaminase) can be inserted in place of a deleted region of a Cas9 polypeptide. The deleted region can correspond to an N-terminal or C-terminal portion of the Cas9 polypeptide. In some embodiments, the deleted region corresponds to residues 792-872 as numbered in the above Cas9 reference sequence, or a corresponding amino acid residue in another Cas9 polypeptide. In some embodiments, the deleted region corresponds to residues 792-906 as numbered in the above Cas9 reference sequence, or a corresponding amino acid residue in another Cas9 polypeptide. In some embodiments, the deleted region corresponds to residues 2-791 as numbered in the above Cas9 reference sequence, or a corresponding amino acid residue in another Cas9 polypeptide. In some embodiments, the deleted region corresponds to residues 1017-1069 as numbered in the above Cas9 reference sequence, or corresponding amino acid residues thereof.

Exemplary internal fusions base editors are provided in Table 9 below:

TABLE 9

Insertion loci in Cas9 proteins

| BE ID | Modification | Other ID |
|---|---|---|
| IBE001 | Cas9 TadA ins 1015 | ISLAY01 |
| IBE002 | Cas9 TadA ins 1022 | ISLAY02 |
| IBE003 | Cas9 TadA ins 1029 | ISLAY03 |
| IBE004 | Cas9 TadA ins 1040 | ISLAY04 |
| IBE005 | Cas9 TadA ins 1068 | ISLAY05 |
| IBE006 | Cas9 TadA ins 1247 | ISLAY06 |
| IBE007 | Cas9 TadA ins 1054 | ISLAY07 |
| IBE008 | Cas9 TadA ins 1026 | ISLAY08 |
| IBE009 | Cas9 TadA ins 768 | ISLAY09 |
| IBE020 | delta HNH TadA 792 | ISLAY20 |
| IBE021 | N-term fusion single TadA helix truncated 165-end | ISLAY21 |
| IBE029 | TadA-Circular Permutant116 ins1067 | ISLAY29 |
| IBE031 | TadA- Circular Permutant 136 ins1248 | ISLAY31 |
| IBE032 | TadA- Circular Permutant 136ins 1052 | ISLAY32 |
| IBE035 | delta 792-872 TadA ins | ISLAY35 |
| IBE036 | delta 792-906 TadA ins | ISLAY36 |
| IBE043 | TadA-Circular Permutant 65 ins1246 | ISLAY43 |
| IBE044 | TadA ins C-term truncate 2791 | ISLAY44 |

A heterologous polypeptide (e.g., deaminase) can be inserted within a structural or functional domain of a Cas9 polypeptide. A heterologous polypeptide (e.g., deaminase) can be inserted between two structural or functional domains of a Cas9 polypeptide. A heterologous polypeptide (e.g., deaminase) can be inserted in place of a structural or functional domain of a Cas9 polypeptide, for example, after deleting the domain from the Cas9 polypeptide. The structural or functional domains of a Cas9 polypeptide can include, for example, RuvC I, RuvC II, RuvC III, Rec1, Rec2, PI, or HNH.

In some embodiments, the Cas9 polypeptide lacks one or more domains selected from the group consisting of: RuvC I, RuvC II, RuvC III, Rec1, Rec2, PI, or HNH domain. In some embodiments, the Cas9 polypeptide lacks a nuclease domain. In some embodiments, the Cas9 polypeptide lacks an HNH domain. In some embodiments, the Cas9 polypeptide lacks a portion of the HNH domain such that the Cas9 polypeptide has reduced or abolished HNH activity. In some embodiments, the Cas9 polypeptide comprises a deletion of the nuclease domain, and the deaminase is inserted to replace the nuclease domain. In some embodiments, the HNH domain is deleted and the deaminase is inserted in its place. In some embodiments, one or more of the RuvC domains is deleted and the deaminase is inserted in its place.

A fusion protein comprising a heterologous polypeptide can be flanked by a N-terminal and a C-terminal fragment of a napDNAbp. In some embodiments, the fusion protein comprises a deaminase flanked by a N-terminal fragment and a C-terminal fragment of a Cas9 polypeptide. The N terminal fragment or the C terminal fragment can bind the target polynucleotide sequence. The C-terminus of the N terminal fragment or the N-terminus of the C terminal fragment can comprise a part of a flexible loop of a Cas9 polypeptide. The C-terminus of the N terminal fragment or the N-terminus of the C terminal fragment can comprise a part of an alpha-helix structure of the Cas9 polypeptide. The N-terminal fragment or the C-terminal fragment can comprise a DNA binding domain. The N-terminal fragment or the C-terminal fragment can comprise a RuvC domain. The N-terminal fragment or the C-terminal fragment can comprise an HNH domain. In some embodiments, neither of the N-terminal fragment and the C-terminal fragment comprises an HNH domain.

In some embodiments, the C-terminus of the N terminal Cas9 fragment comprises an amino acid that is in proximity to a target nucleobase when the fusion protein deaminates the target nucleobase. In some embodiments, the N-terminus of the C terminal Cas9 fragment comprises an amino acid that is in proximity to a target nucleobase when the fusion protein deaminates the target nucleobase. The insertion location of different deaminases can be different in order to have proximity between the target nucleobase and an amino acid in the C-terminus of the N terminal Cas9 fragment or the N-terminus of the C terminal Cas9 fragment. For example, the insertion position of an deaminase can be at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

The N-terminal Cas9 fragment of a fusion protein (i.e. the N-terminal Cas9 fragment flanking the deaminase in a fusion protein) can comprise the N-terminus of a Cas9 polypeptide. The N-terminal Cas9 fragment of a fusion protein can comprise a length of at least about: 100, 200, 300, 400, 500, 600, 700, 800, 900, 1000, 1100, 1200, or 1300 amino acids. The N-terminal Cas9 fragment of a fusion protein can comprise a sequence corresponding to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide.

The C-terminal Cas9 fragment of a fusion protein (i.e. the C-terminal Cas9 fragment flanking the deaminase in a fusion protein) can comprise the C-terminus of a Cas9 polypeptide. The C-terminal Cas9 fragment of a fusion protein can comprise a length of at least about: 100, 200, 300, 400, 500, 600, 700, 800, 900, 1000, 1100, 1200, or 1300 amino acids. The C-terminal Cas9 fragment of a fusion protein can comprise a sequence corresponding to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide.

The N-terminal Cas9 fragment and C-terminal Cas9 fragment of a fusion protein taken together may not correspond to a full-length naturally occurring Cas9 polypeptide sequence, for example, as set forth in the above Cas9 reference sequence.

The fusion protein described herein can effect targeted deamination with reduced deamination at non-target sites (e.g., off-target sites), such as reduced genome wide spurious deamination. The fusion protein described herein can effect targeted deamination with reduced bystander deamination at non-target sites. The undesired deamination or off-target deamination can be reduced by at least 30%, at least 40%, at least 50%, at least 60%, at least 70%, at least 80%, at least 90%, at least 95%, or at least 99% compared with, for example, an end terminus fusion protein comprising the deaminase fused to a N terminus or a C terminus of a Cas9 polypeptide. The undesired deamination or off-target deamination can be reduced by at least one-fold, at least two-fold, at least three-fold, at least four-fold, at least five-fold, at least tenfold, at least fifteen fold, at least twenty fold, at least thirty fold, at least forty fold, at least fifty fold, at least 60 fold, at least 70 fold, at least 80 fold, at least 90 fold, or at least hundred fold, compared with, for example, an end terminus fusion protein comprising the deaminase fused to a N terminus or a C terminus of a Cas9 polypeptide.

In some embodiments, the deaminase (e.g., adenosine deaminase, cytidine deaminase, or adenosine deaminase and cytidine deaminase) of the fusion protein deaminates no more than two nucleobases within the range of an R-loop. In some embodiments, the deaminase of the fusion protein deaminates no more than three nucleobases within the range of the R-loop. In some embodiments, the deaminase of the fusion protein deaminates no more than 2, 3, 4, 5, 6, 7, 8, 9, or 10 nucleobases within the range of the R-loop. An R-loop is a three-stranded nucleic acid structure including a DNA: RNA hybrid, a DNA:DNA or an RNA: RNA complementary structure and the associated with single-stranded DNA. As used herein, an R-loop may be formed when a target polynucleotide is contacted with a CRISPR complex or a base editing complex, wherein a portion of a guide polynucleotide, e.g. a guide RNA, hybridizes with and displaces with a portion of a target polynucleotide, e.g. a target DNA. In some embodiments, an R-loop comprises a hybridized region of a spacer sequence and a target DNA complementary sequence. An R-loop region may be of about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleobase pairs in length. In some embodiments, the R-loop region is about 20 nucleobase pairs in length. It should be understood that, as used herein, an R-loop region is not limited to the target DNA strand that hybridizes with the guide polynucleotide. For example, editing of a target nucleobase within an R-loop region may be to a DNA strand that comprises the complementary strand to a guide RNA, or may be to a DNA strand that is the opposing strand of the strand complementary to the guide RNA. In some embodiments, editing in the region of the R-loop comprises editing a nucleobase on non-complementary strand (protospacer strand) to a guide RNA in a target DNA sequence.

The fusion protein described herein can effect target deamination in an editing window different from canonical base editing. In some embodiments, a target nucleobase is from about 1 to about 20 bases upstream of a PAM sequence in the target polynucleotide sequence. In some embodiments, a target nucleobase is from about 2 to about 12 bases upstream of a PAM sequence in the target polynucleotide sequence. In some embodiments, a target nucleobase is from about 1 to 9 base pairs, about 2 to 10 base pairs, about 3 to 11 base pairs, about 4 to 12 base pairs, about 5 to 13 base pairs, about 6 to 14 base pairs, about 7 to 15 base pairs, about 8 to 16 base pairs, about 9 to 17 base pairs, about 10 to 18 base pairs, about 11 to 19 base pairs, about 12 to 20 base pairs, about 1 to 7 base pairs, about 2 to 8 base pairs, about 3 to 9 base pairs, about 4 to 10 base pairs, about 5 to 11 base pairs, about 6 to 12 base pairs, about 7 to 13 base pairs, about 8 to 14 base pairs, about 9 to 15 base pairs, about 10 to 16 base pairs, about 11 to 17 base pairs, about 12 to 18 base pairs, about 13 to 19 base pairs, about 14 to 20 base pairs, about 1 to 5 base pairs, about 2 to 6 base pairs, about 3 to 7 base pairs, about 4 to 8 base pairs, about 5 to 9 base pairs, about 6 to 10 base pairs, about 7 to 11 base pairs, about 8 to 12 base pairs, about 9 to 13 base pairs, about 10 to 14 base pairs, about 11 to 15 base pairs, about 12 to 16 base pairs, about 13 to 17 base pairs, about 14 to 18 base pairs, about 15 to 19 base pairs, about 16 to 20 base pairs, about 1 to 3 base pairs, about 2 to 4 base pairs, about 3 to 5 base pairs, about 4 to 6 base pairs, about 5 to 7 base pairs, about 6 to 8 base pairs, about 7 to 9 base pairs, about 8 to 10 base pairs, about 9 to 11 base pairs, about 10 to 12 base pairs, about 11 to 13 base pairs, about 12 to 14 base pairs, about 13 to 15 base pairs, about 14 to 16 base pairs, about 15 to 17 base pairs, about 16 to 18 base pairs, about 17 to 19 base pairs, about 18 to 20 base pairs away or upstream of the PAM sequence. In some embodiments, a target nucleobase is about 1, 2, 3, 4, 5, 6, 7, 8, 9, 10, 11, 12, 13, 14, 15, 16, 17, 18, 19, 20, or more base pairs away from or upstream of the PAM sequence. In some embodiments, a target nucleobase is about 1, 2, 3, 4, 5, 6, 7, 8, or 9 base pairs upstream of the PAM sequence. In some embodiments, a target nucleobase is about 2, 3, 4, or 6 base pairs upstream of the PAM sequence.

The fusion protein can comprise more than one heterologous polypeptide. For example, the fusion protein can additionally comprise one or more UGI domains and/or one or more nuclear localization signals. The two or more heterologous domains can be inserted in tandem. The two or more heterologous domains can be inserted at locations such that they are not in tandem in the NapDNAbp.

A fusion protein can comprise a linker between the deaminase and the napDNAbp polypeptide. The linker can be a peptide or a non-peptide linker. For example, the linker can be an XTEN, (GGGS)n (SEQ ID NO: 1308), (GGGGS)n (SEQ ID NO: 109), (G)n, (EAAAK)n (SEQ ID NO: 1309), (GGS)n, SGSETPGTSESATPES (SEQ ID NO: 56). In some embodiments, the fusion protein comprises a linker between the N-terminal Cas9 fragment and the deaminase. In some embodiments, the fusion protein comprises a linker between the C-terminal Cas9 fragment and the deaminase. In some embodiments, the N-terminal and C-terminal fragments of napDNAbp are connected to the deaminase with a linker. In some embodiments, the N-terminal and C-terminal fragments are joined to the deaminase domain without a linker. In some embodiments, the fusion protein comprises a linker between the N-terminal Cas9 fragment and the deaminase, but does not comprise a linker between the C-terminal Cas9 fragment and the deaminase. In some embodiments, the fusion protein comprises a linker between the C-terminal Cas9 fragment and the deaminase, but does not comprise a linker between the N-terminal Cas9 fragment and the deaminase.

In some embodiments, the napDNAbp in the fusion protein is a Cas12 polypeptide, e.g., Cas12b/C2c1, or a fragment thereof. The Cas12 polypeptide can be a variant Cas12 polypeptide. In other embodiments, the N- or C-terminal fragments of the Cas12 polypeptide comprise a nucleic acid programmable DNA binding domain or a RuvC domain. In other embodiments, the fusion protein contains a linker between the Cas12 polypeptide and the catalytic domain. In other embodiments, the amino acid sequence of the linker is GGSGGS (SEQ ID NO: 273) or GSSG-SETPGTSESATPESSG (SEQ ID NO: 1310). In other embodiments, the linker is a rigid linker. In other embodiments of the above aspects, the linker is encoded by GGAGGCTCTGGAGGAAGC (SEQ ID NO: 1311) or GGCTCTTCTGGATCTGAAACACCTGGCACAAGC-GAGAGCGCCACCCCTGAGAGCTCTGGC (SEQ ID NO: 1312).

Fusion proteins comprising a heterologous catalytic domain flanked by N- and C-terminal fragments of a Cas12 polypeptide are also useful for base editing in the methods as described herein. Fusion proteins comprising Cas12 and one or more deaminase domains, e.g. adenosine deaminase, or comprising an adenosine deaminase domain flanked by Cas12 sequences are also useful for highly specific and efficient base editing of target sequences. In an embodiment, a chimeric Cas12 fusion protein contains a heterologous catalytic domain (e.g. adenosine deaminase, cytidine deaminase, or adenosine deaminase and cytidine deaminase) inserted within a Cas12 polypeptide. In some embodiments, the fusion protein comprises an adenosine deaminase domain and a cytidine deaminase domain inserted within a Cas12. In some embodiments, an adenosine deaminase is fused within Cas12 and a cytidine deaminase is fused to the C-terminus. In some embodiments, an adenosine deaminase is fused within Cas12 and a cytidine deaminase fused to the N-terminus. In some embodiments, a cytidine deaminase is fused within Cas12 and an adenosine deaminase is fused to the C-terminus. In some embodiments, a cytidine deaminase is fused within Cas12 and an adenosine deaminase fused to the N-terminus. Exemplary structures of a fusion protein with an adenosine deaminase and a cytidine deaminase and a Cas12 are provided as follows:

NH$_2$-[Cas12(adenosine deaminase)]-[cytidine deaminase]-COOH;

NH$_2$-[cytidine deaminase]-[Cas12(adenosine deaminase)]-COOH;

NH$_2$-[Cas12(cytidine deaminase)]-[adenosine deaminase]-COOH; or

NH$_2$-[adenosine deaminase]-[Cas12(cytidine deaminase)]-COOH;

In some embodiments, the "-" used in the general architecture above indicates the presence of an optional linker.

In various embodiments, the catalytic domain has DNA modifying activity (e.g. deaminase activity), such as adenosine deaminase activity. In some embodiments, the adenosine deaminase is a TadA (e.g., TadA*7.10). In some embodiments, the TadA is a TadA*8. In some embodiments, a TadA*8 is fused within Cas12 and a cytidine deaminase is fused to the C-terminus. In some embodiments, a TadA*8 is fused within Cas12 and a cytidine deaminase fused to the N-terminus. In some embodiments, a cytidine deaminase is fused within Cas12 and a TadA*8 is fused to the C-terminus. In some embodiments, a cytidine deaminase is fused within Cas12 and a TadA*8 fused to the N-terminus. Exemplary structures of a fusion protein with a TadA*8 and a cytidine deaminase and a Cas12 are provided as follows: N-[Cas12 (TadA*8)]-[cytidine deaminase]-C; N-[cytidine deaminase]-[Cas12(TadA*8)]-C; N-[Cas12(cytidine deaminase)]-[TadA*8]-C; or N-[TadA*8]-[Cas12(cytidine deaminase)]-C.

In some embodiments, the "-" used in the general architecture above indicates the presence of an optional linker.

In other embodiments, the fusion protein contains one or more catalytic domains. In other embodiments, at least one of the one or more catalytic domains is inserted within the Cas12 polypeptide or is fused at the Cas12 N-terminus or C-terminus. In other embodiments, at least one of the one or more catalytic domains is inserted within a loop, an alpha helix region, an unstructured portion, or a solvent accessible portion of the Cas12 polypeptide. In other embodiments, the Cas12 polypeptide is Cas12a, Cas12b, Cas12c, Cas12d, Cas12e, Cas12g, Cas12h, Cas12i, or Cas12j/CasΦ. In other embodiments, the Cas12 polypeptide has at least about 85% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide has at least about 90% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide has at least about 95% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide contains or consists essentially of a fragment of *Bacillus hisashii* Cas12b, *Bacillus thermoamylovorans* Cas12b, *Bacillus* sp. V3-13 Cas12b, or *Alicyclobacillus acidiphilus* Cas12b.

In other embodiments, the catalytic domain is inserted between amino acid positions 153-154, 255-256, 306-307, 980-981, 1019-1020, 534-535, 604-605, or 344-345 of BhCas12b or a corresponding amino acid residue of Cas12a, Cas12c, Cas12d, Cas12e, Cas12g, Cas12h, Cas12i, or Cas12j/CasΦ. In other embodiments, the catalytic domain is inserted between amino acids P153 and S154 of BhCas12b. In other embodiments, the catalytic domain is inserted between amino acids K255 and E256 of BhCas12b. In other embodiments, the catalytic domain is inserted between amino acids D980 and G981 of BhCas12b. In other embodiments, the catalytic domain is inserted between amino acids K1019 and L1020 of BhCas12b. In other embodiments, the catalytic domain is inserted between amino acids F534 and P535 of BhCas12b. In other embodiments, the catalytic domain is inserted between amino acids K604 and G605 of BhCas12b. In other embodiments, the catalytic domain is inserted between amino acids H344 and F345 of BhCas12b. In other embodiments, catalytic domain is inserted between amino acid positions 147 and 148, 248 and 249, 299 and 300, 991 and 992, or 1031 and 1032 of BvCas12b or a corresponding amino acid residue of Cas12a, Cas12c, Cas12d, Cas12e, Cas12g, Cas12h, Cas12i, or Cas12j/CasΦ. In other embodiments, the catalytic domain is inserted between amino acids P147 and D148 of BvCas12b. In other embodiments, the catalytic domain is inserted between amino acids G248 and G249 of BvCas12b. In other embodiments, the catalytic domain is inserted between amino acids P299 and E300 of BvCas12b. In other embodiments, the catalytic domain is inserted between amino acids G991 and E992 of BvCas12b. In other embodiments, the catalytic domain is inserted between amino acids K1031 and M1032 of BvCas12b. In other embodiments, the catalytic domain is inserted between amino acid positions 157 and 158, 258 and 259, 310 and 311, 1008 and 1009, or 1044 and 1045 of AaCas12b or a corresponding amino acid residue of Cas12a, Cas12c, Cas12d, Cas12e, Cas12g, Cas12h, Cas12i, or Cas12j/CasΦ. In other embodiments, the catalytic domain is inserted between amino acids P157 and G158 of AaCas12b.

In other embodiments, the catalytic domain is inserted between amino acids V258 and G259 of AaCas12b. In other embodiments, the catalytic domain is inserted between amino acids D310 and P311 of AaCas12b. In other embodiments, the catalytic domain is inserted between amino acids G1008 and E1009 of AaCas12b. In other embodiments, the catalytic domain is inserted between amino acids G1044 and K1045 at of AaCas12b.

In other embodiments, the fusion protein contains a nuclear localization signal (e.g., a bipartite nuclear localization signal). In other embodiments, the amino acid sequence of the nuclear localization signal is MAPKKKRKVGIHGVPAA (SEQ ID NO: 1313). In other embodiments of the above aspects, the nuclear localization signal is encoded by the following sequence:

ATGGCCCCAAAGAAGAAGCGGAAGGTCGGTA-TCCACGGAGTCCCAGCAGCC (SEQ ID NO: 1314). In other embodiments, the Cas12b polypeptide contains a mutation that silences the catalytic activity of a RuvC domain. In other embodiments, the Cas12b polypeptide contains D574A, D829A and/or D952A mutations. In other embodiments, the fusion protein further contains a tag (e.g., an influenza hemagglutinin tag).

In some embodiments, the fusion protein comprises a napDNAbp domain (e.g., Cas12-derived domain) with an internally fused nucleobase editing domain (e.g., all or a portion of a deaminase domain, e.g., an adenosine deaminase domain). In some embodiments, the napDNAbp is a Cas12b. In some embodiments, the base editor comprises a BhCas12b domain with an internally fused TadA*8 domain inserted at the loci provided in Table 10 below.

TABLE 10

Insertion loci in Cas12b proteins

| | Insertion site | Inserted between aa |
|---|---|---|
| BhCas12b | | |
| position 1 | 153 | PS |
| position 2 | 255 | KE |
| position 3 | 306 | DE |
| position 4 | 980 | DG |
| position 5 | 1019 | KL |
| position 6 | 534 | FP |
| position 7 | 604 | KG |
| position 8 | 344 | HF |
| BvCas12b | | |
| position 1 | 147 | PD |
| position 2 | 248 | GG |
| position 3 | 299 | PE |
| position 4 | 991 | GE |
| position 5 | 1031 | KM |
| AaCas12b | | |
| position 1 | 157 | PG |
| position 2 | 258 | VG |
| position 3 | 310 | DP |
| position 4 | 1008 | GE |
| position 5 | 1044 | GK |

By way of nonlimiting example, an adenosine deaminase (e.g., TadA*8.13) may be inserted into a BhCas12b to produce a fusion protein (e.g., TadA*8.13-BhCas12b) that effectively edits a nucleic acid sequence.

In some embodiments, the base editing system described herein is an ABE with TadA inserted into a Cas9. Sequences of relevant ABEs with TadA inserted into a Cas9 are provided.

101 Cas9 TadAins 1015
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFREDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIRK

YPKLESEFVYGDYKVGSSGSETPGTSESATPESSGSEVEFSHEYWMRHAL

TLAKRARDEREVPVGAVLVLNNRVIGEGWNRAIGLHDPTAHAEIMALRQG

GLVMQNYRLIDATLYVTFEPCVMCAGAMIHSRIGRVVFGVRNAKTGAAGS

LMDVLHYPGMNHRVEITEGILADECAALLCYFFRMPRQVFNAQKKAQSST

DYDVRKMTAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLTIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

102 Cas9 TadAins 1022
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNTVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

-continued

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAAKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREPNNYHRAHDAYLNAVVGTALIKK

YPKLESEFVYGDYKVYDVRKMIGSSGSETPGTSESATPESSGSEVEFSHE

YWMRHALTLAKRARDEREVPVGAVLVLNNRVIGEGWNRAIGDHDPTAHAE

IMALRQGGLVMQNYRLIDATLYVTFEPCVMCAGAMIHSRIGRVVFGVRNA

KTGAAGSDMDVLHYPGMNHRVEITEGILADECAALLCYFERMPRQVFNAQ

KKAQSSTDAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

103 Cas9 TadAins 1029
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERRPIFGNIVDEVAYHEKYPTIYHLRKKLVDSTDEAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIRDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHARDAYLNAVVGTALIKK

YPKLESEFVYGDYKVYDVRKMIAKSEQEIGSSGSETPGTSESATPESSGS

EVEFSHEYWMRHALTLAKRARDEREVPVGAVLVLNNRVIGEGWNRAIGLH

DPTAHAEIMALRQGGLVMQNYRLIDATLYVTFEPCVMCAGAMIHSRIGRV

VFGVRNAKTGAAGSLMDVLHYPGMNHRVEITEGILADEGAALLCYFFRMP

RQVFNAQKKAQSSTDGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

103 Cas9 TadAins 1040
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGMNHRVEITEGILADEC

-continued

AALLCYFFRMPRQVFNAQKKAQSSTDNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

105 Cas9 TadAins 1068

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGEGSSGSETPGTSESATPESSGSEVEFSHEYWMR

HALTLAKRARDEREVPVGAVLVLNNRVIGEGWNRAIGLHDPTAHAEIMAL

RQGGLVMQNYRLIDATLYVTFEPCVMCAGAMIHSRIGRVVFGVRNAKTGA

AGSLMDVLHYPGMNHRVEITEGILADECAALLCYFFRMPRQVFNAQKKAQ

SSTDTGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

-continued

106 Cas9 TadAins 1247

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHRAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGGSS

GSFTPGTSESATPESSGSEVEFSHEVWMRHATTTAKRARDRREVPVGAVL

VLNNRVIGEGWNRAIGLHDPTAHAEIMALRQGGLVMQNYRLIDATLYVTE

EPCVMCAGAMIHSRIGRVVFGVRNAKTGAAGSLMDVLHYPGMNHRVEITE

GILADECAALLCYFFRMPRQVFNAQKKAQSSTDSPEDNEQKQLHVEQHKH

YLDEIIEQISEFSKRVILADANLDKVLSAYNKHRDKPIREQAENIIHLET

LTNLGAPAAFKYFDTTIDRKRYTSTKEVLDATLIHQSITGLYETRIDLSQ

LGGD

107 Cas9 TadAins 1054

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

-continued

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLIEGIRDKQSGKTILDFLKSDGFAEREFMQLIRDD

SLTFKEDIQKAQVSGQGDSLHEHIAMLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREIENYHRAHDAYLNAVVGTALIKK

YPKLESEFVYGDYKVYDVRKMIAKSEQEIGKATAKYFFYSNIMNFFKTEI

TLANGSSGSETPGTSESATPESSGSEVEFSHEYWMRHALTLAKRARDERE

VPVGAVLVLNNRVIGEGWNRAIGLHDPTAHAEIMALRQGGLVMQNYRLID

ATLYVTFEPCVMCAGAMIHSRIGRVVFGVRNAKTGAAGSLMDVLHYPGMN

HRVEITEGILADECAALLCYFFRMPRQVFNAQKKAQSSTDGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

108 Cas9 TadAins 1026
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIRDD

SLTFKEDIQKAQVSGQGDSLHEHIANLAGSPAIKKGILQTVKVVDELVKV

-continued

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEGSSGSETPGTSESATPESSGSEVE

FSHEYWMRHALTLAKRARDEREVPVGAVLVLNNRVIGEGWNRAIGLHDPT

AHAEIMALRQGGLVMQNYRLIDATLYVTFEPCVMCAGAMIHSRIGRVVFG

VRNAKTGAAGSLMDVLHYPGMNHRVEITEGILADECAALLCYFFRMPRQV

FNAQKKAQSSTDQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

109 Cas9 TadAins 768
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIRDD

SLTFKEDIQKAQVSGQGDSLHEHIANLAGSPAIKKGILQTVKVVDELVKV

MGRHKPENIVIEMARENQSSGSETPGTSESATPESSGSEVEFSHEYWMR

HALTLAKRARDEREVPVGAVLVLNNRVIGEGWNRAIGLHDPTAHAEIMAL

RQGGLVMQNYRLIDATLYVTFEPCVMCAGAMIHSRIGRVVFGVRNAKTGA

AGSLMDVLHYPGMNHRVEITEGILADEGAALLCYFFRMPRTTQKGQKNSR

ERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQIT

KHVAQILDSRMNTKYDENDKLIREVKVITLKSKLVSDFRKDFQFYKVREI

NNYHHAHDAYLNAVVGTALIKKYPKLESEFVYGDYKVYDVRKMIAKSEQE

IGKATAKYFFYSNIMNFFKTEITLANGEIRKRPLIETNGETGEIVWDKGR

DFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELAL

PSKYVNFLYLASHYEKLKGSPEDNEQKQLEVEQHKHYLDEIIEQISEFSK

RVILADANLDKVLSAYNKHRDKPIREQAENIIHLFTLTNLGAPAAFKYFD

TTIDRKRYTSTKEVLDATLIHQSITGLYETRIDLSQLGGD 110.1 Cas9 TadAins 1250
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPG

SSGSETPGTSESATPESSGSEVEFSHEYWMRHALTLAKRARDEREVPVGA

VLVLNNRVIGEGWNRAIGLHDPTAHAEIMALRQGGLVMQNYRLIDATLYV

TFEPCVMCAGAMIHSRIGRVVFGVRNAKTGAAGSLMDVLHYPGMNHRVEI

TEGILADECAALLCYFFRMPREDNEQKQLFVEQHKHYLDEIIEQISEFSK

RVILADANIDKVLSAYNKHRDKPIREQAENIIHLFTLTNLGAPAAFKYFD

TTIDRKRYTSTKEVLDATLIHQSITGLYETRIDLSQLGGD 110.2 Cas9 TadAins 1250
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLEPDNSDVDKLFTQLVQTYNQLFEENP

INASGVDAKAILSARLSKSRRLENLIAQLPGEKKNGLFGNLIALSLGLTP

NEKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLEREDLLR

KQRTFDNGSIPHQIHLGELHAILRRQEDFYPFLKDNREKIEKILTFRIPY

YVGPLARGNSRFAWMTRKSEETITPWEFEEVVDKGASAQSFTERMTNFDK

NLPNEKVLPKHSLLYEYFTVYNELTKVKYVTEGMRKPAFLSGEQKKAIVD

LLFKTERKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFAEREFMQLIHDD

SLTFKEDIQKAQVSGQGDSLHEHIANLAGSPAIKKGILQTVKVVDELVKV

MGRHKPEEIVIEMARENQTTQKGQKNSRERMKRIEEGIKELGSQILKEHP

VENTQLQEEKLYLYYLQNGRDMYVDQELDIERLSDYDVDHIVPQSFLKDD

SIDEKVLTRSDKNRGKSDNVPSEEVVKKMKEYWRQLLNAKLITQRKFDNL

TKAERGGLSELDKAGFIKRQLVETRQITKHVAQILDSRMETKYDEEDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKEPIDFLEAKGYKEVKKDLIIKLPK

YSLFELENGRKRMLASAGELQKGNELALPSKYVNFLYLASHYEKLKGSPG

SSGSSGSETPGTSESATPESSGSEVEFSHEYWMRHALTLAKRARDEREVP

VGAVLVLENRVIGEGWNRAIGLHDPTAHAEIMALRQGGLVMQNYRLIDAT

LYVTFEPCVMCAGAMIHSRIGRVVFGVRNAKTGAAGSLMDVLHYPGMEHR

VEITEGILADECAALLCYFFRMPREDEEQKQLFVEQHKHYLDEIIEQISE

FSKRVILADANLDKVLSAYNKHRDKPIREQAEEIIHLFTLTNLGAPAAFK

YFDTTIDRKRYTSTKEVLDATLIHQSITGLYETRIDLSQLGGD 110.3 Cas9TadAins 1250
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

-continued

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITLMERSSFEKNPLDFLEAKGYKEVKKDLILKEPK

YSLFELENGRKRMLASAGELQKGNELALPSKYVNFLYLASHYEKLKGSPG

SSGSSGSETPGTSESATPESGSSSGSEVEFSHEYWMRHALTLAKRARDER

EVPVGAVLVLNNRVIGEGWNRAIGLHDPTAHAEIMALRQGGLVMQNYRLI

DATLYVTFEPCVMCAGAMIHSRIGRVVFGVRNAKTGAAGSLMDVIHYPGM

NHRVEITEGILADECAALLCYFFRMPREDNEQKQLFVEQHKYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD 110.4 Cas9 Tad Ains 1250

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSEFHR

LEESFLVEEDKKHERHPIFGNIVDEVAYHEKYPTIYHLRKKLVDSTDEAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFALKRTRKSEETITPWNFEEWDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

-continued

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPG

SSGSSGSETPGTSESATPESGSSSGSEVEFSHEYWMRHALTLAKRARDER

EVPVGAVLVLNNRVIGEGWNRAIGLHDPTAHAEIMALRQGGLVMQNYRLI

DATLYVTFEPCVMCAGAMIHSRIGRVVFGVRNAKTGAAGSLMDVLHYPGM

NHRVEITEGILADECAALLCYFFRMRREDNEQKQLFVEQHKYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD 110.5 Cas9 TadAins 1249

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLEREDLLR

KQRTFDNGSIPHQIHLGELHAILRRQEDFYPFLKDNREKIEKILTFRIPY

YVGPLARGNSRFALKRTRKSEETITPWEFEEWDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSGS

SGSSGSETPGTSESATPESGSSSGSEVEFSHEYWMRHALTLAKRARDERE

-continued

```
VPVGAVLVLNNRVIGEGWNRAIGLHDPTAHAEIMALRQGGLVMQNYRLID

ATLYVTFEPCVMCAGAMIHSRIGRVVFGVRNAKTGAAGSLMDVLHYPGMN

HRVEITEGILADECAALLCYFFRMRRPEDNEQKQLFVEQHKHYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD
```

110.5 Cas9 TadAins delta 59-66 1250
```
MDKKYSIGIALGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

LRDIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSEEKNPIDFLEAKGIKEVKKDLIIKLPK

YSLFELENGRKRMLASAGELQKGNELALPSKYVNFLYLASHYEKLKGSPG

SSGSSGSETPGTSESATPESGSSSGSEVEFSHEYWMRHALTLAKRARDERE

VPVGAVLVLNNRVIGEGWNRAHAEIMALRQGGLVMQNYRLIDATLYVTFE

PCVMCAGAMIHSRIGRVVFGVRNAKTGAAGSLMDVLHYPGMNHRVEITEG

ILADECAALLCYFFRMPRQVFNAQKKAQSSTDEDNEQKQLFVEQHKHYLD

EIIEQISEFSKRVILADANLDKVLSAYNKHRDKPIREQAENIIHLFTLTN

LGAPAAFKYFDTTIDRKRYTSTKEVLDATLIHQSITGLYETRIDLSQLGG
```

110.6 Cas9 TadAins 1251
```
MDKKYSIGLALGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRDIYLALAHMIKFRGHFLIEGDLNPDNSDVDKLFIQLVQTYNQLFEENP
```

-continued

```
INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRISRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDLNRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

GSSGSSGSETPGTSESATPESGSSSGSEVEFSHEYWMRHALTLAKRARDE

REVPVGAVLVLNNRVIGEGWNRAIGLHDPTAHAEIMALRQGGLVMQNYRL

IDATLYVTFEPCVMCAGAMIHSRIGRVVFGVRNAKTGAAGSLMDVLHYPG

MNHRVEITEGILADECAALLCYFFRMRRDNEQKQLFVEQHKHYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD
```

110.7 Cas9 TadAins 1252
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ
```

-continued

LKRRRYTGWGRISRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDLNRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DGSSGSSGSETPGTSESATPESGSSSGSEVEFSHEYWMRHALTLAKRARD

EREVPVGAVLVLNNRVIGEGWNRAIGLHDPTAHAEIMALRQGGLVMQNYR

LIDATLYVTFEPCVMCAGAMIHSRIGRVVFGVRNAKTGAAGSLMDVLHYP

GMNHRVEITEGILADECAALLCYFFRMRRNEQKQLFVEQHKHYLDEIIEQ

ISEFSKRVILADANLDKVLSAYNKHRDKPIREQAENIIHLFTLTNLGAPA

AFKYFDTTIDRKRYTSTKEVLDATLIHQSITGLYETRIDLSQLGGD 110.8 Cas9 TadAins delta 59-66 C-truncate 1250
MDKKYSIGLATGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRISRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSEEKNPIDFLEAKGIKEVKKDLIIKLPK

YSLFELENGRKRMLASAGELQKGNELALPSKYVNFLYLASHYEKLKGSPG

SSGSETPGTSESATPESSGSEVEFSHEYWMRHALTLAKRARDEREVPVGA

VLVLNNRVIGEGWNRAHAEIMALRQGGLVMQNYRLIDATLYVTFEPCVMC

AGAMIHSRIGRVVFGVRNAKTGAAGSLMDVLHYPGMNHRVEITEGILADE

CAALLCYFFRMPRQEDNEQKQLFVEQHKHYLDEIIEQISEFSKRVILADA

NLDKVLSAYNKHRDKPIREQAENIIHLFTLTNLGAPAAFKYFDTTIDRKR

YTSTKEVLDATLIHQSITGLYETRIDLSQLGGD 111.1 Cas9 TadAins 997
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRDIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVIHYPGMNHRVEITEGILADEGAALLCYFFRMPRQVFNAQ

KKAQSSTDGSSGSETPGTSESATPESSGIKKYPKLESEFVYGDYKVYDVR

KMIAKSEQEIGKATAKYFFYSNIMNFFKTEITLANGEIRKRPLIETNGET

GEIVWDKGRDFATVRKVLSMPQVNIVKKTEVQTGGFSKESILPKRNSDKL

IARKKDWDPKKYGGFDSPTVAYSVLVVAKVEKGKSKKLKSVKELLGITIM

ERSSFEKNPIDFLEAKGYKEVKKDLIIKLPKYSLFELENGRKRMLASAGE

LQKGNELALPSKYVNFLYLASHYEKLKGSPEDNEQKQLFVEQHKHYLDEI

IEQISEFSKRVILADANLDKVLSAYNKHRDKPIREQAENIIHLFTLTNLG

APAAFKYFDTTIDRKRYTSTKEVLDATLIHQSITGLYETRIDLSQLGGD

-continued 111.2 Cas9 TadAins 997
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRDIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVIHYPGMNHRVEITEGILADECAALLCYFFRMPRQVFNAQ

KKAQSSTDGSSGSSGSETPGTSESATPESSGGSSIKKYPKLESEFVYGDY

KVYDVRKMIAKSEQEIGKATAKYFFYSNIMNFFKTEITLANGEIRKRPLI

ETNGETGEIVWDKGRDFATVRKVLSMPQVNIVKKTEVQTGGFSKESILPK

RNSDKLIARKKDWDPKKYGGFDSPTVAYSVLVVAKVEKGKSKKLKSVKEL

LGITIMERSSFEKNPIDFLEAKGYKEVKKDLIIKLPKYSLFELENGRKRM

LASAGELQKGNELALPSKYVNFLYLASHYEKLKGSPEDNEQKQLFVEQHK

HYLDEIIEQISEFSKRVILADANLDKVLSAYNKHRDKPIREQAENIIHLF

TLTNLGAPAAFKYFDTTIDRKRYTSTKEVLDATLIHQSITGLYETRIDLS

QLGGD 112 delta HNH Tad A
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNTVDEVAYHEKYPTIYHLRKKLVDSTDEAD

LRDIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

-continued
FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSEVEFSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDGGLSELDKAGFIKRQLVETRQITKHVAQILDSRMNTKYDEND

KLIREVKVITLKSKLVSDFRKDFQFYKVREINNYHHAHDAYLNAVVGTAL

IKKYPKLESEFVYGDYKVYDVRKMIAKSEQEIGKATAKYFFYSNIMNFFK

TEITLANGEIRKRPLIETNGETGEIVWDKGRDFATVRKVLSMPQVNIVKK

TEVQTGGFSKESILPKRNSDKLIARKKDWDPKKYGGFDSPTVAYSVLVVA

KVEKGKSKKLKSVKELLGITIMERSSFEKNPIDFLEAKGYKEVKKDLIIK

LPKYSLFELENGRKRMLASAGELQKGNELALPSKYVNFLYLASHYEKLKG

SPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATL

IHQSITGLYETRIDLSQLGGD

113 N-term single TadA helix trunc 165-end
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRSGGSSGGSSGSETPGTSESATPESSGGSSGGSDKKYSIGLAIGTNSV

GWAVITDEYKVPSKKFKVLGNTDRHSIKKNLIGALLFDSGETAEATRLKR

TARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRG

HFLIEGDLNPDNSDVDKLFIQLVQTYNQLFEENPINASGVDAKAILSARL

SKSRRLENLIAQLPGEKKNGLFGNLIALSLGLTPNFKSNFDLAEDAKLQL

SKDTYDDDLDNLLAQIGDQYADLFLAAKNLSDAILLSDILRVNTEITKAP

LSASMIKRYDEHHQDLTLLKALVRQQLPEKYKEIFFDQSKNGYAGYIDGG

ASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMT

RKSEETITPWNFEEVVDKGASAQSFIERMTNFDKNLPNEKVLPKHSLLYE

YFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKL

INGIRDKQSGKTILDFLKSDGFANRNFMQLIHDDSLTFKEDIQKAQVSGQ

-continued

GDSLHEHIANLAGSPAIKKGILQTVKVVDELVKVMGRHKPENIVIEMARE

NQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGF

IKRQLVETRQITKHVAQILDSRMNTKYDENDKLIREVKVITLKSKLVSDF

RKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETN

GETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYL

DEIIEQISEFSKRVILADANLDKVLSAYNKHRDKPIREQAENIIHLFTLT

NLGAPAAFKYFDTTIDRKRYTSTKEVLDATLIHQSITGLYETRIDLSQLG

GD

114 N-term single TadA helix trunc 165-end delta
59-65
MSEVEFSHEYWMRHALTLAKRARDEREVPVGAVLVLNNRVIGEGWNRTAH

AEIMALRQGGLVMQNYRLIDATLYVTFEPCVMCAGAMIHSRIGRVVFGVR

NAKTGAAGSLMDVLHYPGMNHRVEITEGILADECAALLCYFFRMPRSGGS

SGGSSGSETPGTSESATPESSGGSSGGSDKKYSIGLAIGTNSVGWAVITD

EYKVPSKKFKVLGNTDRHSIKKNLIGALLFDSGETAEATRLKRTARRRYT

RRKNRICYLQEIFSNEMAKVDDSFFHRLEESFLVEEDKKHERHPIFGNIV

DEVAYHEKYPTIYHLRKKLVDSTDKADLRLIYLALAHMIKFRGHFLIEGD

LNPDNSDVDKLFIQLVQTYNQLFEENPINASGVDAKAILSARLSKSRRLE

NLIAQLPGEKKNGLFGNLIALSLGLTPNFKSNFDLAEDAKLQLSKDTYDD

DLDNLLAQIGDQYADLFLAAKNLSDAILLSDILRVNTEITKAPLSASMIK

RYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAIL

RRQEDFYPFLKDNREKIEKILTFRIPYYVGPLARGNSRFAWMTRKSEETI

TPWNFEEVVDKGASAQSFIERMTNFDKNLPNEKVLPKHSLLYEYFTVYNE

LTKVKYVTEGMRKPAFLSGEQKKAIVDLLFKTNRKVTVKQLKEDYFKKIE

CFDSVEISGVEDRFNASLGTYHDLLKIIKDKDFLDNEENEDILEDIVLTL

TLFEDREMIEERLKTYAHLFDDKVMKQLKRRRYTGWGRLSRKLINGIRDK

QSGKTILDFLKSDGFANRNFMQLIHDDSLTFKEDIQKAQVSGQGDSLHEH

IANLAGSPAIKKGILQTVKVVDELVKVMGRHKPENIVIEMARENQTTQKG

QKNSRERMKRIEEGIKELGSQILKEHPVENTQLQNEKLYLYYLQNGRDMY

VDQELDINRLSDYDVDHIVPQSFLKDDSIDNKVLTRSDKNRGKSDNVPSE

EVVKKMKNYWKQLLNAKLLTQRKEDNLTKAEKGGLSELDKAGELKKQLVE

TRQITKHVAQILDSRMNTKYDENDKLIREVKVITLKSKLVSDFRKDFQFY

KVREINNYHHAHDAYLNAVVGTALIKKYPKLESEFVYGDYKVYDVRKMIA

KSEQEIGKATAKYFFYSNIMNFFKTEITLANGEIRKRPLIETNGETGEIV

WDKGRDFATVRKVLSMPQVNIVKKTEVQTGGFSKESILPKRNSDKLIARK

-continued

KDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKG

NELALPSKYVNFLYLASHYEKLKGSPEDNEQKQLFVEQHKHYLDEIIEQI

SEFSKRVILADANLDKVLSAYNKHRDKPIREQAENIIHLFTLTNLGAPAA

FKYFDTTIDRKRYTSTKEVLDATLIHQSITGLYETRIDLSQLGGD 115.1 Cas9 TadAins 1004
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKGSSGSETPGTSESATPESSGGSEVEFSHEYWMRHALTLAKRARDEREV

PVGAVLVLNNRVIGEGWNRAIGLHDPTAHAEIMALRQGGLVMQNYRLIDA

TLYVTFEPCVMCAGAMIHSRIGRVVFGVRNAKTGAAGSLMDVLHYPGMNH

RVEITEGILADEGAALLCYFFRMPRQLESEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD 115.2 Cas9 TadAins 1005
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

-continued
```
LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NEKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAAKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLGSSGSETPGTSESATPESSGSEVEFSHEYWMRHALTLAKRARDERE

VPVGAVLVLNNRVIGEGWNRAIGLHDPTAHAEIMALRQGGLVMQNYRLID

ATLYVTFEPCVMCAGAMIHSRIGRVVFGVRNAKTGAAGSLMDVLHYPGMN

HRVEITEGILADECAALLCYFFRMPRQESEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD
```

115.3 Cas9 TadAins 1006
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NEKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI
```

-continued
```
IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLEGSSGSETPGTSESATPESSGSEVEFSHEYWMRHALTLAKRARDER

EVPVGAVLVLNNRVIGEGWNRAIGLHDPTAHAEIMALRQGGLVMQNYRLI

DATLYVTFEPCVMCAGAMIHSRIGRVVFGVRNAKTGAAGSLMDVIHYPGM

NHRVEITEGILADECAALLCYFFRMPRQESEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD
```

115.4 Cas9 TadAins 1007
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLEREDLLR

KQRTFDNGSIPHQIHLGELHAILRRQEDFYPFLKDNREKIEKILTFRIPY

YVGPLARGNSRFAWMTRKSEETITPWEFEEVVDKGASAQSFIERMTNFDK

NLPNEKVLPKHSLLYEYFTVYNELTKVKYVTEGMRKPAFLSGEQKKAIVD

LLFKTERKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFAEREFMQLIRDD

SLTFKEDIQKAQVSGQGDSLHEHIANLAGSPAIKKGILQTVKVVDELVKV

MGRHKPEEIVIEMARENQTTQKGQKNSRERMKRIEEGIKELGSQILKEHP

VENTQLQEEKLYLYYLQNGRDMYVDQELDIERLSDYDVDHIVPQSFLKDD

SIDEKVLTRSDKNRGKSDNVPSEEVVKKMKEYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESGSSGSETPGTSESATPESSGSEVEFSHEYWMRHALTLAKRARDE
```

-continued

```
REVPVGAVLVLNNRVIGEGWNRAIGLHDPTAHAEIMALRQGGLVMQNYRL

IDATLYVTFEPCVMCAGAMIHSRIGRVVFGVRNAKTGAAGSLMDVLHYPG

MEHRVEITEGILADECAALLCYFFRMPRQEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD
```

116.1 Cas9 TadAins C-term truncate2 792

```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLEREDLLR

KQRTFDNGSIPHQIHLGELHAILRRQEDFYPFLKDNREKIEKILTFRIPY

YVGPLARGNSRFAWMTRKSEETITPWEFEEVVDKGASAQSFIERMTNFDK

NLPEEKVLPKHSLLYEYFTVYNELTKVKYVTEGMRKPAFLSGEQKKAIVD

LLFKTERKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLIEGIRDKQSGKTILDFLKSDGFAEREFMQLIHDD

SLTFKEDIQKAQVSGQGDSLHEHIANLAGSPAIKKGILQTVKVVDELVKV

MGRHKPEEIVIEMARENQTTQKGQKNSRERMKRIEEGIKELGGSSGSETP

GTSESATPESSGSEVEFSHEYWMRHALTLAKRARDEREVPVGAVLVLENR

VIGEGWNRAIGLHDPTAHAEIMALRQGGLVMQEYRLIDATLYVTFEPCVM

CAGAMIHSRIGRVVFGVRNAKTGAAGSLMDVLHYPGMNHRVEITEGILAD

ECAALLCYFFRMPRQSQILKEHPVENTQLQEEKLYLYYLQNGRDMYVDQE

LDINRLSDYDVDHIVPQSFLKDDSIDNKVLTRSDKNRGKSDNVPSEEVVK

KMKNYWRQLLNAKLITQRKFDNLTKAERGGLSELDKAGFIKRQLVETRQI

TKHVAQILDSRMNTKYDENDKLIREVKVITLKSKLVSDFRKDFQFYKVRE

LENYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDEEQKQLFVEQHKHYLDEIIEQISEFS
```

```
KRVILADANLDKVLSAYNKHRDKPIREQAENIIHLFTLTNLGAPAAFKYF

DTTTDRKRYTSTKEVLDATLIHQSITGLYETRIDLSQLGGD
```

116.2 Cas9 TadAins C-term truncate2 791

```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFAEREFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSSGSETPG

TSESATPESSGSEVEFSHEYWMRHALTLAKRARDEREVPVGAVLVLNNRV

IGEGWERAIGLHDPTAHAEIMALRQGGLVMQNYRLIDATLYVTFEPCVMC

AGAMIHSRIGRVVFGVRNAKTGAAGSLMDVLHYPGMEHRVEITEGILADE

GAALLCYFFRMPRQGSQILKEHPVENTQLQEEKLYLYYLQNGRDMYVDQE

LDINRLSDYDVDHIVPQSFLKDDSIDNKVLTRSDKNRGKSDNVPSEEVVK

KMKNYWRQLLNAKLITQRKFDNLTKAERGGLSELDKAGFIKRQLVETRQI

TKHVAQILDSRMNTKYDENDKLIREVKVITLKSKLVSDFRKDFQFYKVRE

INNYHHAHDAYLNAVVGTALLKRYPKLESEEVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD
```

116.3 Cas9 TadAins C-term truncate2 790

```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI
```

-continued

```
LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKEGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGMNHRVEITEGILADEC

AALLCYFFRMPRQLGSQILKEHPVENTQLQNEKLYLYYLQNGRDMYVDQE

LDINRLSDYDVDHLVFQSHLKDDSIDNKVLIRSDKNKGKSDNVPSEEVVK

KMKNYWRQLLNAKLITQRKFDNLTKAERGGLSELDKAGFIKRQLVETRQI

TKHVAQILDSRMNTKYDENDKLIREVKVITLKSKLVSDFRKDFQFYKVRE

INNYHHAHDAYLNAVVGTALLKKYPKLESEEVYGDYKVYDVRKMIAKSEQ

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEKN

PIDFLEAKGYKEVKKDLIIKLPKYSLFELENGRKRMLASAGELQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPAAFKYF

DTTIDRKRYTSTKEVLDATLIHQSITGLYETRIDLSQLGGD
```

117 Cas9 delta 1017-1069
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSEFHR

LEESFLVEEDKKHERHPIFGNIVDEVAYHEKYPTIYHLRKKLVDSTDEAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFALKRTRKSEETITPWNFEEWDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV
```

-continued

```
MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYSSGSEVEFSHEYWMRHALTLAKRARDEREVPVGA

VLVLNNRVIGEGWNRAIGLHDPTAHAEIMALRQGGLVMQNYRLIDATLYV

TFEPCVMCAGAMIHSRIGRVVFGVRNAKTGAAGSLMDVLHYPGMNHRVEI

TEGILADECAALLCYFFRMPRQVFNAQKKAQSSTDGEIVWDKGRDFATVR

KVLSMPQVNIVKKTEVQTGGFSKESILPKRNSDKLIARKKDWDPKKYGGF

DSPTVAYSVLVVAKVEKGKSKKLKSVKELLGITIMERSSFEKNPIDFLEA

KGYKEVKKDLIIKLPKYSLFELENGRKRMLASAGELQKGNELALPSKYVN

FLYLASHYEKLKGSPEDNEQKQLFVEQHKHYLDEIIEQISEFSKRVILAD

ANLDKVLSAYNKHRDKPIREQAENIIHLFTLTNLGAPAAFKYFDTTIDRK

RYTSTKEVLDATLIHQSITGLYETRIDLSQLGGD
```

118 Cas9 TadA-CP116ins 1067
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNMNHRVEITEGILADECAALLCYFFRMPRQVFNAQ

KKAQSSTDGSSGSETPGTSESATPESSGSEVEFSHEYWMRHALTLAKRAR

DEREVPVGAVLVLNNRVIGEGWNRAIGLHDPTAHAEIMALRQGGLVMQNY

RLIDATLYVTFEPCVMCAGAMIHSRIGRVVFGVRNAKTGAAGSLMDVLHY
```

-continued

PGGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

119 Cas9 TadAins 701
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SGSSGSETPGTSESATPESSGSEVEFSHEYWMRHALTLAKRARDEREVPV

GAVLVLNNRVIGEGWNRAIGLHDPTAHAEIMALRQGGLVMQNYRLIDATL

YVTFEPCVMCAGAMIHSRIGRVVFGVRNAKTGAAGSLMDVLHYPGMNHRV

EITEGILADECAALLCYFFRMPRQVFNAQKKAQSSTDLTFKEDIQKAQVS

GQGDSLHEHIANLAGSPAIKKGILQTVKVVDELVKVMGRHKPENIVIEMA

RENQTTQKGQKNSRERMKRIEEGIKELGSQILKEHPVENTQLQNEKLYLY

YLQNGRDMYVDQELDINRLSDYDVDHIVPQSFLKDDSIDNKVLTRSDKNR

GKSDNVPSEEVVKKMKNYWRQLLNAKLITQRKFDNLTKAERGGLSELDKA

GFIKRQLVETRQITKHVAQILDSRMNTKYDENDKLIREVKVITLKSKLVS

DFRKDFQFYKVREINNYHHAHDAYLNAVVGTALIKKYPKLESEFVYGDYK

VYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

120 Cas9 TadACP136ins 1248
MDKKYSIGLALGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRDIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRISRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDLNRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSMN

HRVEITEGILADECAALLCYFFRMPRQVFNAQKKAQSSTDGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

121 Cas9TadACP136ins 1052
MDKKYSTGLALGTNSVGWAVITDEYKVPSKKFKVLGNTDRHSTKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

-continued

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRISRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDLNRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLAMNHRVEITEGILADECAALLCYFFRMPRQVFNAQKKAQSSTDGSSGS

ETPGTSESATPESSGSEVEFSHEYWMRHALTLAKRARDEREVPVGAVLVI

NNRVIGEGWNRAIGLHDPTAHAEIMALRQGGLVMQNYRLIDATLYVTFEP

CVMCAGAMIHSRIGRVVFGVRNAKTGAAGSLMDVLHYPGNGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLTIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

122 Cas9 TadACP136ins 1041
MDKKYSTGLAIGTNSVGWAVITDEYKVPSKKFKVLGNTDRHSTKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRISRKLINGIRDKQSGKTILDFLKSDGFANRNFMQLIHDD

SLTFKEDIQKAQVSGQGDSLHEHIANLAGSPAIKKGILQTVKVVDELVKV

-continued

MGRHKPENIVIEMARENQTTQKGQKNSRERMKRIEEGIKELGSQILKEHP

VENTQLQNEKLYLYYLQNGRDMYVDQELDLNRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSMNHRVEITEG

ILADECAALLCYFERMPRQVFNAQKKAQSSTDGSSGSETPGTSESATPES

SGSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSRI

GRVVFGVRNAKTGAAGSLMDVLHYPGNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLTTKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

123 Cas9 TadACP139ins 1299
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRISRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDLNRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

-continued

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVTLADANLDKVLSAYNKHRMN

HRVEITEGILADECAALLCYFFRMPRQVFNAQKKAQSSTDGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGDKPIREQAENIIHLFT

LTNLGAPAAFKYFDTTIDRKRYTSTKEVLDATLIHQSITGLYETRIDLSQ

LGGD

124 Cas9 delta 792-872 TadAins
MDKKYSTGLALGTNSVGWAVITDEYKVPSKKFKVLGNTDRHSTKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYLDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRISRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVLEMARENQTTQKGQKNSRERMKRIEEGIKELGSEVEFSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADEGAALLCYFFRMPRQVFNAQ

KKAQSSTDEEVVKKMKNYWRQLLNAKLITQRKFDNLTKAERGGLSELDKA

GFIKRQLVETRQTTKHVAQILDSRMNTKYDENDKLIREVKVITLKSKLVS

DFRKDFQFYKVREINNYHHAHDAYLNAVVGTALIKKYPKLESEFVYGDYK

VYDVRKMIAKSEQEIGKATAKYFFYSNIMNFFKTEITLANGEIRKRPLTE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

-continued

125 Cas9 delta 792-906 TadAins
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSEVEFSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDGLSELDKAGFIKRQLVETRQITKHVAQILDSRMNTKYDENDK

LIREVKVITLKSKLVSDFRKDFQFYKVREINNYHHAHDAYLNAVVGTALI

KKYPKLESEFVYGDYKVYDVRKMIAKSEQEIGKATAKYFFYSNIMNFFKT

EITLANGEIRKRPLIETNGETGEIVWDKGRDFATVRKVISMPQVNIVKKT

EVQTGGFSKESILPKRNSDKLIARKKDWDPKKYGGFDSPTVAYSVLVVAK

VEKGKSKKLKSVKELLGITIMERSSFEKNPIDFLEAKGYKEVKKDLIIKL

PKYSLFELENGRKRMLASAGELQKGNELALPSKYVNFLYLASHYEKLKGS

PEDNEQKQLFVEQHKHYLDEIIEQISEFSKRVILADANLDKVLSAYNKHR

DKPIREQAENIIHLFTLTNLGAPAAFKYFDTTIDRKRYTSTKEVLDATLI

HQSITGLYETRIDLSQLGGD

126 TadA CP65ins 1003
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDEAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

-continued

```
NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

PRQVFNAQKKAQSSTDGSSGSETPGTSESATPESSGSEVEFSHEYWMRHA

LTLAKRARDEREVPVGAVLVLNNRVIGEGWNRAIGLHDPLESEFVYGDYK

VYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

127 TadA CP65ins 1016
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLEREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL
```

```
TKAERGGLSELDKAGFTKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVTAHAEIMALRQGGLVMQNYRLIDATLYVTFEPCVM

CAGAMIHSRIGRVVFGVRNAKTGAAGSLMDVLHYPGMNHRVEITEGILAD

ECAALLCYFFRMPRQVFNAQKKAQSSTDGSSGSETPGTSESATPESSGSE

VEFSHEYWMRHALTLAKRARDEREVPVGAVLVLNNRVIGEGWNRAIGLHD

PYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

128 TadA CP65ins 1022
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMITAHAEIMALRQGGLVMQNYRLIDATLYV

TFEPCVMCAGAMIHSRIGRVVFGVRNAKTGAAGSLMDVLHYPGMNHRVEI

TEGILADECAALLCYFFRMPRQVFNAQKKAQSSTDGSSGSETPGTSESAT

PESSGSEVEFSHEYWMRHALTLAKRARDEREVPVGAVLVLNNRVIGEGWN

RAIGLHDPAKSEQEIGKATAKYFFYSNIMNFFKTEITLANGEIRKRPLIE

TNGETGEIVWDKGRDFATVRKVLSMPQVNIVKKTEVQTGGFSKESILPKR
```

-continued

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

129 TadA CP65ins 1029
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEYKELKPILEKMDGTEELLVKLNKEDLLR

KQRTFDNGSIPHQIHLGELHAILRRQEDFYPFLKDNREKIEKILTFRIPY

YVGPLARGNSRFAWMTRKSEETITPWNFEEVVDKGASAQSFTERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEITAHAEIMALRQGGLVMQNYRL

IDATLYVTFEPCVMCAGAMIHSRIGRVVFGVRNAKTGAAGSLMDVLHYPG

MNHRVEITEGILADEGAALLCYFERMPRQVFNAQKKAQSSTDGSSGSETP

GTSESATPESSGSEVEFSHEYWMRHALTLAKRARDEREVPVGAVLVLNNR

VIGEGWNRAIGLHDPGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLTTKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

130 TadA CP65ins 1041
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

-continued

LEESELVEEDKKHERHPIFGNIVDEVAYHEKYPTIYHLRKKLVDSTDEAD

LRLIYLALARMIKFRGHFLIEGDLNPDNSDVDELFIQLVQTYNQLFEENP

INASGVDAKAILSARLSKSRRLENLIAQLPGEEKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLEREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGETILDFLKSDGFANRNFMQLIHDD

SLTFKEDIQKAQVSGQGDSLHEHIANDAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSTAHAEIMALR

QGGLVMQNYRLIDATLYVTFEPCVMCAGAMIHSRIGRVVFGVRNAKTGAA

GSLMDVLHYPGMNHRVEITEGILADECAALLCYFFRMPRQVFNAQKKAQS

STDGSSGSETPGTSESATPESSGSEVEFSHEYWMRHALTLAKRARDEREV

PVGAVLVLNNRVIGEGWNRAIGLHDPNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLTIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

131 TadA CP65ins 1054
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERRPIFGNIVDEVAYHEKYPTIYHLRKKLVDSTDKAD

LRLIYLALARMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDELLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEWDKGASAQSFIERI4TNFDK

-continued

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTDGSSGSETPGTSESATPESSGSEVEFSHEYWMRH

ALTLAKRARDEREVPVGAVLVLNNRVIGEGWNRAIGLHDPGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

132 TadA CP65ins 1246
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNTVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NEKSNFDLAEDAKLQLSKDTYDDDLDHLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

-continued

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGTAH

AEIMALRQGGLVMQNYRLIDATLYVIFEPCVMCAGAMIHSRIGRVVFGVR

NAKTGAAGSLMDVLHYPGMNHRVEITEGILADECAALLCYFFRMPRQVFN

AQKKAQSSTDGSSGSETPGTSESATPESSGSEVEFSHEYWMRHALTLAKR

ARDEREVPVGAVLVLNNRVIGEGWNRAIGLHDPSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD

In some embodiments, adenosine deaminase base editors were generated to insert TadA or variants thereof into the Cas9 polypeptide at the identified positions.

Exemplary, yet nonlimiting, fusion proteins are described in International PCT Application Nos. PCT/US2020/016285 and U.S. Provisional Application Nos. 62/852,228 and 62/852,224, the contents of which are incorporated by reference herein in their entireties.

A to G Editing

In some embodiments, a base editor described herein comprises a fusion protein comprising an adenosine deaminase domain. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein can comprise a Cas9 domain that has reduced nuclease activity. In some embodiments, the fusion proteins provided herein can have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, an A-to-G base editor further comprises an inhibitor of inosine base excision repair, for example, a uracil glyco-sylase inhibitor (UGI) domain or a catalytically inactive inosine specific nuclease. Without wishing to be bound by any particular theory, the UGI domain or catalytically inac-tive inosine specific nuclease can inhibit or prevent base excision repair of a deaminated adenosine residue (e.g., inosine), which can improve the activity or efficiency of the base editor.

A base editor comprising an adenosine deaminase can act on any polynucleotide, including DNA, RNA and DNA-RNA hybrids. In certain embodiments, a base editor com-prising an adenosine deaminase can deaminate a target A of a polynucleotide comprising RNA. For example, the base editor can comprise an adenosine deaminase domain capable of deaminating a target A of an RNA polynucleotide and/or a DNA-RNA hybrid polynucleotide. In an embodiment, an adenosine deaminase incorporated into a base editor com-prises all or a portion of adenosine deaminase acting on RNA (ADAR, e.g., ADAR1 or ADAR2). In another embodi-ment, an adenosine deaminase incorporated into a base editor comprises all or a portion of adenosine deaminase acting on tRNA (ADAT). A base editor comprising an adenosine deaminase domain can also be capable of deami-nating an A nucleobase of a DNA polynucleotide. In an embodiment an adenosine deaminase domain of a base editor comprises all or a portion of an ADAT comprising one or more mutations which permit the ADAT to deaminate a target A in DNA. For example, the base editor can comprise all or a portion of an ADAT from *Escherichia coli* (EcTadA) comprising one or more of the following mutations: D108N, A106V, D147Y, E155V, L84F, H123Y, I156F, or a corre-sponding mutation in another adenosine deaminase.

The adenosine deaminase can be derived from any suit-able organism (e.g., *E. coli*). In some embodiments, the adenosine deaminase is from a prokaryote. In some embodi-ments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulo-bacter crescentus*, or *Bacillus subtilis*. In some embodi-ments, the adenosine deaminase is from *E. coli*. In some embodiments, the adenine deaminase is a naturally-occur-ring adenosine deaminase that includes one or more muta-tions corresponding to any of the mutations provided herein (e.g., mutations in ecTadA). The corresponding residue in any homologous protein can be identified by e.g., sequence alignment and determination of homologous residues. The mutations in any naturally-occurring adenosine deaminase (e.g., having homology to ecTadA) that correspond to any of the mutations described herein (e.g., any of the mutations identified in ecTadA) can be generated accordingly.

Adenosine Deaminases

In some embodiments, the fusion proteins of the invention comprise one or more adenosine deaminase domains. In some embodiments, the adenosine deaminases provided herein are capable of deaminating adenine. In some embodi-ments, the adenosine deaminases provided herein are capable of deaminating adenine in a deoxyadenosine residue of DNA. The adenosine deaminase may be derived from any suitable organism (e.g., *E. coli*). In some embodiments, the adenine deaminase is a naturally-occurring adenosine deaminase that includes one or more mutations correspond-ing to any of the mutations provided herein (e.g., mutations in ecTadA). One of skill in the art will be able to identify the corresponding residue in any homologous protein, e.g., by sequence alignment and determination of homologous resi-dues. Accordingly, one of skill in the art would be able to generate mutations in any naturally-occurring adenosine deaminase (e.g., having homology to ecTadA) that corre-sponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulo-bacter crescentus*, or *Bacillus subtilis*. In some embodi-ments, the adenosine deaminase is from *E. coli*.

The invention provides adenosine deaminase variants that have increased efficiency (>50-60%) and specificity. In particular, the adenosine deaminase variants described herein are more likely to edit a desired base within a polynucleotide, and are less likely to edit bases that are not intended to be altered (i.e., "bystanders").

In some embodiments, the adenosine deaminase is a TadA deaminase. In particular embodiments, the TadA is any one of the TadA described in PCT/US2017/045381 (WO 2018/027078), which is incorporated herein by reference in its entirety.

A wild type TadA(wt) adenosine deaminase has the fol-lowing sequence (also termed TadA reference sequence):

```
MSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIHSR

IGRVVFGARDARTGAAGSLMDVLHHPGMNHRVEITEGILADECAALLSD

FFRMRRQEIKAQKKAQSSTD
```

In some embodiments the adenosine deaminase is a full-length *E. coli* TadA deaminase. For example, in certain embodiments, the adenosine deaminase comprises the amino acid sequence:

```
MRRAFITGVFFLSEVEFSHEYWMRHALTLAKRAWDEREVPVGAVLVHNN

RVIGEGWNRPIGRHDPTAHAEIMALRQGGLVMQNYRLIDATLYVTLEPC

VMCAGAMIHSRIGRVVFGARDAKTGAAGSLMDVLHHPGMNHRVEITEGI

LADECAALLSDFFRMRRQEIKAQKKAQSSTD.
```

In some embodiments, the adenosine deaminase is from a prokaryote. In some embodiments, the adenosine deaminase is from a bacterium. In some embodiments, the adenosine deaminase is from *Escherichia coli* (*E. coli*), *Staphylococcus aureus* (*S. aureus*), *Salmonella typhimurium* (*S. typhimu-rium*), *Shewanella putrefaciens* (*S. putrefaciens*), *Haemo-philus influenzae* (*H. influenzae*), *Caulobacter crescentus* (*C. crescentus*), *Geobacter sulfurreducens* (*G. sulfurre-ducens*), or *Bacillus subtilis*. In some embodiments, the adenosine deaminase is from *E. coli*.

It should be appreciated, however, that additional adenos-ine deaminases useful in the present application would be apparent to the skilled artisan and are within the scope of this disclosure. For example, the adenosine deaminase may be a homolog of adenosine deaminase acting on tRNA (ADAT). Without limitation, the amino acid sequences of exemplary AD AT homologs include the following:

*Staphylococcus aureus (S. aureus)* TadA:
MGSHMTNDIYFMTLAIEEAKKAAQLGEVPIGAIITKDDEVIARAHNLRETLQQPTAHAEHIAIE
RAAKVLGSWRLEGCTLYVTLEPCVMCAGTIVMSRIPRVVYGADDPKGGCSGSLMNLLQQSNFNH
RAIVDKGVLKEACSTLLTTFFKNLRANKKSTN

*Bacillus subtilis (B. subtilis)* TadA:
MTQDELYMKEAIKEAKKAEEKGEVPIGAVLVINGEIIARAHNLRETEQRSIAHAEMLVIDEACK
ALGTWRLEGATLYVTLEPCPMCAGAVVLSRVEKVVFGAFDPKGGCSGTLMNLLQEERFNHQAEV
VSGVLEEECGGMLSAFFRELRKKKKAARKNLSE

*Salmonella typhimurium (S. typhimurium)* TadA:
MPPAFITGVTSLSDVELDHEYWMRHALTLAKRAWDEREVPVGAVLVHNHRVIGEGWNRPIGRHD
PTAHAEIMALRQGGLVLQNYRLLDTTLYVTLEPCVMCAGAMVHSRIGRVVFGARDAKTGAAGSL
IDVLHHPGMNHRVEIIEGVLRDECATLLSDFFRMRRQEIKALKKADRAEGAGPAV

*Shewanella putrefaciens (S. putrefaciens)* TadA:
MDEYWMQVAMQMAEKAEAAGEVPVGAVLVKDGQQIATGYNLSISQHDPTAHAEILCLRSAGKKL
ENYRLLDATLYITLEPCAMCAGAMVHSRIARVVYGARDEKTGAAGTVVNLLQHPAFNHQVEVTS
GVLAEACSAQLSRFFKRRRDEKKALKLAQRAQQGIE

*Haemophilus influenzae* F3031 *(H. influenzae)* TadA:
MDAAKVRSEFDEKMMRYALELADKAEALGEIPVGAVLVDDARNIIGEGWNLSIVQSDPTAHAEI
IALRNGAKNIQNYRLLNSTLYVTLEPCTMCAGAILHSRIKRLVFGASDYKTGAIGSRFHFFDDY
KMNHTLEITSGVIAEECSQKLSTFFQKRREEKKIEKALLKSLSDK

*Caulobacter crescentus (C. crescentus)* TadA:
MRTDESEDQDHRMMRLALDAARAAAEAGETPVGAVILDPSTGEVIATAGNGPIAAHDPTAHAEI
AAMRAAAAKLGNYRLTDLTLVVTLEPCAMCAGAISHARIGRVVFGADDPKGGAVVHGPKFFAQP
TCHWRPEVTGGVLADESADLLRGFFRARRKAKI

*Geobacter sulfurreducens (G. sulfurreducens)* TadA:
MSSLKKTPIRDDAYWMGKAIREAAKAAARDEVPIGAVIVRDGAVIGRGHNLREGSNDPSAHAEM
IAIRQAARRSANWRLTGATLYVTLEPCLMCMGAIILARLERVVFGCYDPKGGAAGSLYDLSADP
RLNHQVRLSPGVCQEECGTMLSDFFRDLRRRKKAKATPALFIDERKVPPEP An embodiment of *E. Coli* TadA (ecTadA) includes the following:
MSEVEFSHEYWMRHALTLAKRARDEREVPVGAVLVLNNRVIGEGWNRAIGLHDPTAHAEIMALR
QGGLVMQNYRLIDATLYVTFEPCVMCAGAMIHSRIGRVVFGVRNAKTGAAGSLMDVLHYPGMNH
RVEITEGILADECAALLCYFFRMPRQVFNAQKKAQSSTD In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identify plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

It should be appreciated that any of the mutations provided herein (e.g., based on the TadA reference sequence) can be introduced into other adenosine deaminases, such as *E. coli* TadA (ecTadA), *S. aureus* TadA (saTadA), or other adenosine deaminases (e.g., bacterial adenosine deaminases). It would be apparent to the skilled artisan that additional deaminases may similarly be aligned to identify homologous amino acid residues that can be mutated as provided herein. Thus, any of the mutations identified in the TadA reference sequence can be made in other adenosine deaminases (e.g., ecTada) that have homologous amino acid residues. It should also be appreciated that any of the mutations provided herein can be made individually or in any combination in the TadA reference sequence or another adenosine deaminase.

In some embodiments, the adenosine deaminase comprises a D108X mutation in the TadA reference sequence, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in TadA reference sequence, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase (e.g. ecTadA).

In some embodiments, the adenosine deaminase comprises a E155X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase (e.g., ecTadA).

In some embodiments, the adenosine deaminase comprises a D147X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase (e.g., ecTadA).

In some embodiments, the adenosine deaminase comprises an A106X, E155X, or D147X, mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E155D, E155G, or E155V mutation. In some embodiments, the adenosine deaminase comprises a D147Y.

It should be appreciated that any of the mutations provided herein (e.g., based on the ecTadA amino acid sequence of TadA reference sequence) may be introduced into other adenosine deaminases, such as S. aureus TadA (saTadA), or other adenosine deaminases (e.g., bacterial adenosine deaminases). It would be apparent to the skilled artisan how to are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase.

For example, an adenosine deaminase may contain a D108N, a A106V, a E155V, and/or a D147Y mutation in TadA reference sequence, or a corresponding mutation in another adenosine deaminase (e.g., ecTadA). In some embodiments, an adenosine deaminase comprises the following group of mutations (groups of mutations are separated by a ";") in TadA reference sequence, or corresponding mutations in another adenosine deaminase: D108N and A106V; D108N and E155V; D108N and D147Y; A106V and E155V; A106V and D147Y; E155V and D147Y; D108N, A106V, and E155V; D108N, A106V, and D147Y; D108N, E155V, and D147Y; A106V, E155V, and D147Y; and D108N, A106V, E155V, and D147Y. It should be appreciated, however, that any combination of corresponding mutations provided herein may be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95L, V102A, F104L, A106V, R107C, or R107H, or R107P, D108G, or D108N, or D108V, or D108A, or D108Y, K110I, M118K, N127S, A138V, F149Y, M151V, R153C, Q154L, 1156D, and/or K157R mutation in TadA reference sequence, or one or more corresponding mutations in another adenosine deaminase.

In some embodiments, the adenosine deaminase comprises one or more of a H8X, D108X, and/or N127X mutation in TadA reference sequence, or one or more corresponding mutations in another adenosine deaminase, where X indicates the presence of any amino acid. In some embodiments, the adenosine deaminase comprises one or more of a H8Y, D108N, and/or N127S mutation in TadA reference sequence, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, and D108X, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R26X, L68X, D108X, N127X, D147X, and E155X, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of H8X, R126X, L68X, D108X, N127X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five mutations selected from the group consisting of H8X, D108X, A109X, N127X, and E155X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase (e.g., ecTadA). In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, R26W, L68Q, D108N, N127S, D147Y, and E155V in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase (e.g., ecTadA).

In some embodiments, the adenosine deaminase comprises one or more of the or one or more corresponding mutations in another adenosine deaminase. In some embodiments, the adenosine deaminase comprises a D108N, D108G, or D108V mutation in TadA reference sequence, or corresponding mutations in another adenosine deaminase. In some embodiments, the adenosine deaminase comprises a A106V and D108N mutation in TadA reference sequence, or corresponding mutations in another adenosine deaminase. In some embodiments, the adenosine deaminase comprises R107C and D108N mutations in TadA reference sequence, or corresponding mutations in another adenosine deaminase. In some embodiments, the adenosine deaminase comprises a H8Y, D108N, N127S, D147Y, and Q154H mutation in TadA reference sequence, or corresponding mutations in another adenosine deaminase. In some embodiments, the adenosine deaminase comprises a H8Y, D108N, N127S, D147Y, and E155V mutation in TadA reference sequence, or corresponding mutations in another adenosine deaminase. In some embodiments, the adenosine deaminase comprises a D108N, D147Y, and E155V mutation in TadA reference sequence, or corresponding mutations in another adenosine deaminase. In some embodiments, the adenosine deaminase comprises a H8Y, D108N, and N127S mutation in TadA reference sequence, or corresponding mutations in another adenosine deaminase. In some embodiments, the adenosine deaminase comprises a A106V, D108N, D147Y, and E155V mutation in TadA reference sequence, or corresponding mutations in another adenosine deaminase (e.g., ecTadA).

In some embodiments, the adenosine deaminase comprises one or more of S2X, H8X, I49X, L84X, H123X, N127X, I156X, and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F, and/or K160S mutation in TadA reference sequence, or one or more corresponding mutations in another adenosine deaminase (e.g., ecTadA).

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase (e.g., ecTadA).

In some embodiments, the adenosine deaminase comprises an H123X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase.

In some embodiments, the adenosine deaminase comprises an I156X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an I156F mutation in TadA reference sequence, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five mutations selected from the group consisting of H8X, A106X, D108X, N127X, and K160X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and 1156F in TadA reference sequence, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in TadA reference sequence.

In some embodiments, the adenosine deaminase comprises one, two, three, four, or five mutations selected from the group consisting of H8Y, A106T, D108N, N127S, and K160S in TadA reference sequence, or a corresponding mutation or mutations in another adenosine deaminase.

In some embodiments, the adenosine deaminase comprises one or more of a E25X, R26X, R107X, A142X, and/or A143X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R107K, R107A, R107N, R107W, R107H, R107S, A142N, A142D, A142G, A143D, A143G, A143E, A143L, A143W, A143M, A143S, A143Q, and/or A143R mutation in TadA reference sequence, or one or more corresponding mutations in another adenosine deaminase. In some embodiments, the adenosine deaminase comprises one or more of the mutations described herein corresponding to TadA reference sequence, or one or more corresponding mutations in another adenosine deaminase.

In some embodiments, the adenosine deaminase comprises an E25X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase (e.g., ecTadA).

In some embodiments, the adenosine deaminase comprises an R26X mutation in TadA reference sequence, or a corresponding mutation in another adenosine deaminase, where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase (e.g., ecTadA).

In some embodiments, the adenosine deaminase comprises an R107X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R107P, R107K, R107A, R107N, R107W, R107H, or R107S mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase (e.g., ecTadA).

In some embodiments, the adenosine deaminase comprises an A143X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q, and/or A143R mutation in TadA reference sequence, or a corresponding mutation in another adenosine deaminase (e.g., ecTadA).

In some embodiments, the adenosine deaminase comprises one or more of a H36X, N37X, P48X, I49X, R51X, M70X, N72X, D77X, E134X, S146X, Q154X, K157X, and/or K161X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in TadA reference sequence, or one or more corresponding mutations in another adenosine deaminase (e.g., ecTadA).

In some embodiments, the adenosine deaminase comprises an H36X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase.

In some embodiments, the adenosine deaminase comprises an N37X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an N37T or N37S mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an P48T or P48L mutation in TadA reference sequence, or a corresponding mutation in another adenosine deaminase.

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H or R51L mutation in TadA reference sequence, or a corresponding mutation in another adenosine deaminase.

In some embodiments, the adenosine deaminase comprises an S146X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an S146R or S146C mutation in TadA reference sequence, or a corresponding mutation in another adenosine deaminase.

In some embodiments, the adenosine deaminase comprises an K157X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase.

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase.

In some embodiments, the adenosine deaminase comprises an W23X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a W23R or W23L mutation in TadA reference sequence, or a corresponding mutation in another adenosine deaminase.

In some embodiments, the adenosine deaminase comprises an R152X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a R152P or R52H mutation in TadA reference sequence, or a corresponding mutation in another adenosine deaminase.

In one embodiment, the adenosine deaminase may comprise the mutations H36L, R51L, L84F, A106V, D108N, H123Y, S146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses:

(A106V_D108N),
(R107C_D108N),
(H8Y_D108N_N127S_D147Y_Q154H),
(H8Y_D108N_N127S_D147Y_E155V),
(D108N_D147Y_E155V),
(H8Y_D108N_N127S),
(H8Y_D108N_N127S_D147Y_Q154H),
(A106V_D108N_D147Y_E155V),
(D108Q_D147Y_E155V),
(D108M_D147Y_E155V),
(D108L_D147Y_E155V),
(D108K_D147Y_E155V),
(D108I_D147Y_E155V),
(D108F_D147Y_E155V),
(A106V_D108N_D147Y),
(A106V_D108M_D147Y_E155V),
(E59A_A106V_D108N_D147Y_E155V),
(E59A cat dead_A106V_D108N_D147Y_E155V),
(L84F_A106V_D108N_H123Y_D147Y_E155V_
    I156Y), (L84F_A106V_D108N_H123Y_D147Y_E155V_
    I156F),
(D103A_D104N),
(G22P_D103A_D104N),
(D103A_D104N_S138A),
(R26G_L84F_A106V_R107H_D108N_H123Y_
    A142N_A143D_D147Y_E155V_I156F),
(E25G_R26G_L84F_A106V_R107H_D108N_H123Y_
    A142N_A143D_D147Y_E155V_I156F),
(E25D_R26G_L84F_A106V_R107K_D108N_H123Y_
    A142N_A143G_D147Y_E155V_I156F),
(R26Q_L84F_A106V_D108N_H123Y_A142N_
    D147Y_E155V_I156F),
(E25M_R26G_L84F_A106V_R107P_D108N_H123Y_
    A142N_A143D_D147Y_E155V_I156F),
(R26C_L84F_A106V_R107H_D108N_H123Y_
    A142N_D147Y_E155V_I156F),
(L84F_A106V_D108N_H123Y_A142N_A143L_
    D147Y_E155V_I156F),
(R26G_L84F_A106V_D108N_H123Y_A142N_
    D147Y_E155V_I156F),
(E25A_R26G_L84F_A106V_R107N_D108N_
    H123Y_A142N_A143E_D147Y_E155V_I156F),
(R26G_L84F_A106V_R107H_D108N_H123Y_
    A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_
    A143G_D147Y_E155V),
(R26G_A106V_D108N_R107H_A142N_A143D_
    D147Y_E155V),
(E25D_R26G_A106V_D108N_A142N_D147Y_
    E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_H123Y_S146C_
    D147Y_E155V_I156F_K157N),
(N37T_P48T_M70L_L84F_A106V_D108N_H123Y_
    D147Y_149V_E155V_I156F),
(N37S_L84F_A106V_D108N_H123Y_D147Y_
    E155V_I156F_K161T),
(H36L_L84F_A106V_D108N_H123Y_D147Y_
    Q154H_E155V_I156F),
(N72S_L84F_A106V_D108N_H123Y_S146R_
    D147Y_E155V_I156F),
(H36L_P48L_L84F_A106V_D108N_H123Y_
    E134G_D147Y_E155V_I156F),
(H36L_L84F_A106V_D108N_H123Y_D147Y_
    E155V_I156F_K157N)
(H36L_L84F_A106V_D108N_H123Y_S146C_
    D147Y_E155V_I156F),
(L84F_A106V_D108N_H123Y_S146R_D147Y_
    E155V_I156F_K161T),
(N37S_R51H_D77G_L84F_A106V_D108N_
    H123Y_D147Y_E155V_I156F),
(R51L_L84F_A106V_D108N_H123Y_D147Y_
    E155V_I156F_K157N),
(D24G_Q71R_L84F_H96L_A106V_D108N_
    H123Y_D147Y_E155V_I156F_K160E),
(H36L_G67V_L84F_A106V_D108N_H123Y_
    S146T_D147Y_E155V_I156F),
(Q71L_L84F_A106V_D108N_H123Y_L137M_
    A143E_D147Y_E155V_I156F),
(E25G_L84F_A106V_D108N_H123Y_D147Y_
    E155V_I156F_Q159L), (L84F_A91T_F104I_A106V_D108N_H123Y_
D147Y_E155V_I156F),
(N72D_L84F_A106V_D108N_H123Y_G125A_
D147Y_E155V_I156F),
(P48S_L84F_S97C_A106V_D108N_H123Y_
D147Y_E155V_I156F),
(W23G_L84F_A106V_D108N_H123Y_D147Y_
E155V_I156F),
(D24G_P48L_Q71R_L84F_A106V_D108N_H123Y_
D147Y_E155V_I156F_Q159L),
(L84F_A106V_D108N_H123Y_A142N_D147Y_
E155V_I156F),
(H36L_R51L_L84F_A106V_D108N_H123Y_
A142N_S146C_D147Y_E155V_I156F_K157N),
(N37S_L84F_A106V_D108N_H123Y_A142N_
D147Y_E155V_I156F_K161T),
(L84F_A106V_D108N_D147Y_E155V_I156F),
(R51L_L84F_A106V_D108N_H123Y_S146C_
D147Y_E155V_I156F_K157N_K161T),
(L84F_A106V_D108N_H123Y_S146C_D147Y_
E155V_I156F_K161T),
(L84F_A106V_D108N_H123Y_S146C_D147Y_
E155V_I156F_K157N_K160E_K161T),
(L84F_A106V_D108N_H123Y_S146C_D147Y_
E155V_I156F_K157N_K160E),
(R74Q_L84F_A106V_D108N_H123Y_D147Y_
E155V_I156F),
(R74A_L84F_A106V_D108N_H123Y_D147Y_
E155V_I156F),
(L84F_A106V_D108N_H123Y_D147Y_E155V_I156F),
(R74Q_L84F_A106V_D108N_H123Y_D147Y_
E155V_I156F),
(L84F_R98Q_A106V_D108N_H123Y_D147Y_
E155V_I156F),
(L84F_A106V_D108N_H123Y_R129Q_D147Y_
E155V_I156F),
(P48S_L84F_A106V_D108N_H123Y_A142N_
D147Y_E155V_I156F),
(P48S_A142N),
(P48T_I49V_L84F_A106V_D108N_H123Y_A142N_
D147Y_E155V_I156F_L157N),
(P48T_I49V_A142N),
(H36L_P48S_R51L_L84F_A106V_D108N_H123Y_
S146C_D147Y_E155V_I156F_K157N),
(H36L_P48S_R51L_L84F_A106V_D108N_H123Y_
S146C_A142N_D147Y_E155V_I156F
(H36L_P48T_I49V_R51L_L84F_A106V_D108N_
H123Y_S146C_D147Y_E155V_I156F_K157N),
(H36L_P48T_I49V_R51L_L84F_A106V_D108N_
H123Y_A142N_S146C_D147Y_E155V_I156F_
K157N),
(H36L_P48A_R51L_L84F_A106V_D108N_H123Y_
S146C_D147Y_E155V_I156F_K157N),
(H36L_P48A_R51L_L84F_A106V_D108N_H123Y_
A142N_S146C_D147Y_E155V_I156F_K157N),
(H36L_P48A_R51L_L84F_A106V_D108N_H123Y_
S146C_A142N_D147Y_E155V_I156F_K157N),
(W23L_H36L_P48A_R51L_L84F_A106V_D108N_
H123Y_S146C_D147Y_E155V_I156F_K157N),
(W23R_H36L_P48A_R51L_L84F_A106V_D108N_
H123Y_S146C_D147Y_E155V_I156F_K157N),
(W23L_H36L_P48A_R51L_L84F_A106V_D108N_
H123Y_S146R_D147Y_E155V_I156F_K161T),
(H36L_P48A_R51L_L84F_A106V_D108N_H123Y_
S146C_D147Y_R152H_E155V_I156F_K157N),
(H36L_P48A_R51L_L84F_A106V_D108N_H123Y_
S146C_D147Y_R152P_E155V_I156F_K157N), (W23L_H36L_P48A_R51L_L84F_A106V_D108N_
H123Y_S146C_D147Y_R152P_E155V_I156F_
K157N),
(W23L_H36L_P48A_R51L_L84F_A106V_D108N_
H123Y_A142A_S146C_D147Y_E155V_I156F_
K157N),
(W23L_H36L_P48A_R51L_L84F_A106V_D108N_
H123Y_A142A_S146C_D147Y_R152P_E155V_
I156F_K157N),
(W23L_H36L_P48A_R51L_L84F_A106V_D108N_
H123Y_S146R_D147Y_E155V_I156F_K161T),
(W23R_H36L_P48A_R51L_L84F_A106V_D108N_
H123Y_S146C_D147Y_R152P_E155V_I156F
_K157N), (H36L_P48A_R51L_L84F_A106V_D108N_
H123Y_A142N_S146C_D147Y_R152P_E155
V_I156F_K157N).

In some embodiments, the TadA deaminase is TadA variant. In some embodiments, the TadA variant is TadA*7.10. In particular embodiments, the fusion proteins comprise a single TadA*7.10 domain (e.g., provided as a monomer). In other embodiments, the fusion protein comprises TadA*7.10 and TadA(wt), which are capable of forming heterodimers. In one embodiment, a fusion protein of the invention comprises a wild-type TadA linked to TadA*7.10, which is linked to Cas9 nickase.

In some embodiments, TadA*7.10 comprises at least one alteration. In some embodiments, the adenosine deaminase comprises an alteration in the following sequence:

```
TadA*7.10
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD
```

In some embodiments, TadA*7.10 comprises an alteration at amino acid 82 and/or 166. In particular embodiments, TadA*7.10 comprises one or more of the following alterations: Y147T, Y147R, Q154S, Y123H, V82S, T166R, and/or Q154R. In other embodiments, a variant of TadA*7.10 comprises a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

In some embodiments, an adenosine deaminase variant (e.g., TadA*8) comprises a deletion. In some embodiments, an adenosine deaminase variant comprises a deletion of the C terminus. In particular embodiments, an adenosine deaminase variant comprises a deletion of the C terminus beginning at residue 149, 150, 151, 152, 153, 154, 155, 156, and 157, relative to TadA*7.10, the TadA reference sequence, or a corresponding mutation in another TadA.

In other embodiments, an adenosine deaminase variant (e.g., TadA*8) is a monomer comprising one or more of the following alterations: Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant (TadA*8) is a monomer comprising a combination of alterations selected from the group of: Y147T+Q154R; Y147T+Q154S; Y147R+Q154S; V82S+Q154S;

V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In other embodiments, the adenosine deaminase variant is a homodimer comprising two adenosine deaminase domains (e.g., TadA*8) each having one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a homodimer comprising two adenosine deaminase domains (e.g., TadA*8) each having a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In other embodiments, the adenosine deaminase variant is a heterodimer of a wild-type adenosine deaminase domain and an adenosine deaminase variant domain (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a heterodimer of a wild-type adenosine deaminase domain and an adenosine deaminase variant domain (e.g., TadA*8) comprising a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In other embodiments, the adenosine deaminase variant is a heterodimer of a TadA*7.10 domain and an adenosine deaminase variant domain (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a heterodimer of a TadA*7.10 domain and an adenosine deaminase variant domain (e.g., TadA*8) comprising a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In particular embodiments, an adenosine deaminase heterodimer comprises a TadA*8 domain and an adenosine deaminase domain selected from *Staphylococcus aureus* (*S. aureus*) TadA, *Bacillus subtilis* (*B. subtilis*) TadA, *Salmonella typhimurium* (*S. typhimurium*) TadA, *Shewanella putrefaciens* (*S. putrefaciens*) TadA, *Haemophilus influenzae* F3031 (*H. influenzae*) TadA, *Caulobacter crescentus* (*C. crescentus*) TadA, Geobacter sulfurreducens (G. sulfurreducens) TadA, or TadA*7.10.

In some embodiments, an adenosine deaminase is a TadA*8. In one embodiment, an adenosine deaminase is a TadA*8 that comprises or consists essentially of the following sequence or a fragment thereof having adenosine deaminase activity:

```
MSEVEFSHEYWMRHALTLAKRARDEREVPVGAVLVLNNRVIGEGWNRAI

GLHDPTAHAEIMALRQGGLVMQNYRLIDATIYVTFEPCVMCAGAMIHSR

IGRVVFGVRNAKTGAAGSLMDVLHYPGMNHRVEITEGILADECAALLCT

FFRMPRQVFNAQKKAQSSTD
```

In some embodiments, the TadA*8 is truncated. In some embodiments, the truncated TadA*8 is missing 1, 2, 3, 4, 5,6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5,6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In some embodiments the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

In other embodiments, a base editor of the disclosure comprising an adenosine deaminase variant (e.g., TadA*8) monomer comprising one or more of the following alterations: R26C, V88A, A109S, T111R, D119N, H122N, Y147D, F149Y, T166I and/or D167N, relative to TadA*7.10, the TadA reference sequence, or a corresponding mutation in another TadA. In other embodiments, the adenosine deaminase variant (TadA*8) monomer comprises a combination of alterations selected from the group of: R26C+A109S+T111R+D119N+H122N+Y147D+F149Y+T166I+D167N; V88A+A109S+T111R+D119N+H122N+F149Y+T166I+D167N; R26C+A109S+T111R+D119N+H122N+F149Y+T166I+D167N; V88A+T111R+D119N+F149Y; and A109S+T111R+D119N+H122N+Y147D+F149Y+T166I+D167N, relative to TadA*7.10, the TadA reference sequence, or a corresponding mutation in another TadA.

In other embodiments, a base editor comprises a heterodimer of a wild-type adenosine deaminase domain and an adenosine deaminase variant domain (e.g., TadA*8) comprising one or more of the following alterations R26C, V88A, A109S, T111R, D119N, H122N, Y147D, F149Y, T166I and/or D167N, relative to TadA*7.10, the TadA reference sequence, or a corresponding mutation in another TadA. In other embodiments, the base editor comprises a heterodimer of a wild-type adenosine deaminase domain and an adenosine deaminase variant domain (e.g., TadA*8) comprising a combination of alterations selected from the group of: R26C+A109S+T111R+D119N+H122N+Y147D+F149Y+T166I+D167N; V88A+A109S+T111R+D119N+

H122N+F149Y+T166I+D167N; R26C+A109S+T111R+D119N+H122N+F149Y+T166I+D167N; V88A+T111R+D119N+F149Y; and A109S+T111R+D119N+H122N+Y147D+F149Y+T166I+D167N, relative to TadA*7.10, the TadA reference sequence, or a corresponding mutation in another TadA.

In other embodiments, a base editor comprises a heterodimer of a TadA*7.10 domain and an adenosine deaminase variant domain (e.g., TadA*8) comprising one or more of the following alterations R26C, V88A, A109S, T111R, D119N, H122N, Y147D, F149Y, T166I and/or D167N, relative to TadA*7.10, the TadA reference sequence, or a corresponding mutation in another TadA. In other embodiments, the base editor comprises a heterodimer of a TadA*7.10 domain and an adenosine deaminase variant domain (e.g., TadA*8) comprising a combination of alterations selected from the group of: R26C+A109S+T111R+D119N+H122N+Y147D+F149Y+T166I+D167N; V88A+A109S+T111R+D119N+H122N+F149Y+T166I+D167N; R26C+A109S+T 11R+D119N+H122N+F149Y+T166I+D167N; V88A+T111R+D119N+F149Y; and A109S+T111R+D119N+H122N+Y147D+F149Y+T166I+D167N, relative to TadA*7.10, the TadA reference sequence, or a corresponding mutation in another TadA.

In some embodiments, the TadA*8 is a variant as shown in Table 11. Table 11 shows certain amino acid position numbers in the TadA amino acid sequence and the amino acids present in those positions in the TadA-7.10 adenosine deaminase. Table 11 also shows amino acid changes in TadA variants relative to TadA-7.10 following phage-assisted non-continuous evolution (PANCE) and phage-assisted continuous evolution (PACE), as described in M. Richter et al., 2020, Nature Biotechnology, doi.org/10.1038/s41587-020-0453-z, the entire contents of which are incorporated by reference herein. In some embodiments, the TadA*8 is TadA*8a, TadA*8b, TadA*8c, TadA*8d, or TadA*8e. In some embodiments, the TadA*8 is TadA*8e.

In one embodiment, a fusion protein of the invention comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the fusion protein comprises TadA*8 and TadA(wt), which are capable of forming heterodimers.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In particular embodiments, a TadA*8 comprises one or more mutations at any of the following positions shown in bold. In other embodiments, a TadA*8 comprises one or more mutations at any of the positions shown with underlining:

TABLE 11

| | | Additional TadA*8 Variants | | | | | | | | | |
|---|---|---|---|---|---|---|---|---|---|---|---|
| | | TadA TadA amino acid number | | | | | | | | | |
| | | 26 | 88 | 109 | 111 | 119 | 122 | 147 | 149 | 166 | 167 |
| | TadA-7.10 | R | V | A | T | D | H | Y | F | T | D |
| PANCE 1 | | | | | R | | | | | | |
| PANCE 2 | | | | S/T | R | | | | | | |
| PACE | TadA-8a | C | | S | R | N | N | D | Y | I | N |
| | TadA-8b | | A | S/T | R | N | N | | Y | I | N |
| | TadA-8c | C | | S | R | N | N | | Y | I | N |
| | TadA-8d | | A | | R | N | | | Y | | |
| | TadA-8e | | | S | R | N | N | D | Y | I | N |

```
MSEVEFSHEY WMRHALTLAK RARDEREVPV GAVLVLNNRV IGEGWNRAIG    50

LHDPTAHAEI MALRQGGLVM QNYRLIDATL YVTEEPCVMC AGAMIHSRIG   100

RVVFGVRNAK TGAAGSLMDV LHYPGMNHRV EITEGILADE CAALLCYFFR   150

MPRQVFNAQK KAQSSTD
```

For example, the TadA*8 comprises alterations at amino acid position 82 and/or 166 (e.g., V82S, T166R) alone or in combination with any one or more of the following Y147T, Y147R, Q154S, Y123H, and/or Q154R, relative to TadA*7.10, the TadA reference sequence, or a corresponding mutation in another TadA. In particular embodiments, a combination of alterations is selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In some embodiments, the adenosine deaminase is TadA*8, which comprises or consists essentially of the following sequence or a fragment thereof having adenosine deaminase activity:

```
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCT

FFRMPRQVFNAQKKAQSSTD
```

In some embodiments, the TadA*8 is truncated. In some embodiments, the truncated TadA*8 is missing 1, 2, 3, 4, 5,6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5,6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In one embodiment, a fusion protein of the invention comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the base editor comprises TadA*8 and TadA(wt), which are capable of forming heterodimers.

In particular embodiments, the fusion proteins comprise a single (e.g., provided as a monomer) TadA*8. In some embodiments, the TadA*8 is linked to a Cas9 nickase. In some embodiments, the fusion proteins of the invention comprise as a heterodimer of a wild-type TadA (TadA(wt)) linked to a TadA*8. In other embodiments, the fusion proteins of the invention comprise as a heterodimer of a TadA*7.10 linked to a TadA*8. In some embodiments, the base editor is ABE8 comprising a TadA*8 variant monomer. In some embodiments, the base editor is ABE8 comprising a heterodimer of a TadA*8 and a TadA(wt). In some embodiments, the base editor is ABE8 comprising a heterodimer of a TadA*8 and TadA*7.10. In some embodiments, the base editor is ABE8 comprising a heterodimer of a TadA*8. In some embodiments, the TadA*8 is selected from Table 11, 13 or 14. In some embodiments, the ABE8 is selected from Table 13, 14 or 16.

In some embodiments, the adenosine deaminase is a TadA*9 variant. In some embodiments, the adenosine deaminase is a TadA*9 variant selected from the variants described below and with reference to the following sequence (termed TadA*7.10).

```
                                        (SEQ ID NO: 8)
          10         20         30         40
MSEVEFSHEY WMRHALTLAK RARDEREVPV GAVLVLNNRV 50         60         70         80
IGEGWNRAIG LHDPTAHAEI MALRQGGLVM QNYRLIDATL 90        100        110        120
YVTFEPCVMC AGAMIHSRIG RVVFGVRNAK TGAAGSLMDV 130        140        150        160
LHYPGMNHRV EITEGILADE CAALLCYFFR MPRQVFNAQK

KAQSSTD
```

In some embodiments, an adenosine deaminase comprises one or more of the following alterations: R21N, R23H, E25F, N38G, L51W, P54C, M70V, Q71M, N72K, Y73S, V82T, M94V, P124W, T133K, D139L, D139M, C146R, and A158K. The one or more alternations are shown in the sequence above in underlining and bold font.

In some embodiments, an adenosine deaminase comprises one or more of the following combinations of alterations: V82S+Q154R+Y147R; V82S+Q154R+Y123H; V82S+Q154R+Y147R+Y123H; Q154R+Y147R+Y123H+I76Y+V82S; V82S+I76Y; V82S+Y147R; V82S+Y147R+Y123H; V82S+Q154R+Y123H; Q154R+Y147R+Y123H+I76Y; V82S+Y147R; V82S+Y147R+Y123H; V82S+Q154R+Y123H; V82S+Q154R+Y147R; V82S+Q154R+Y147R; Q154R+Y147R+Y123H+I76Y; Q154R+Y147R+Y123H+I76Y+V82S; I76Y_V82S_Y123H_Y147R Q154R; Y147R+Q154R+H123H; and V82S+Q154R.

In some embodiments, an adenosine deaminase comprises one or more of the following combinations of alterations: E25F+V82S+Y123H, T133K+Y147R+Q154R; E25F+V82S+Y123H+Y147R+Q154R; L51W+V82S+Y123H+C146R+Y147R+Q154R; Y73S+V82S+Y123H+Y147R+Q154R; P54C+V82S+Y123H+Y147R+Q154R; N38G+V82T+Y123H+Y147R+Q154R; N72K+V82S+Y123H+D139L+Y147R+Q154R; E25F+V82S+Y123H+D139M+Y147R+Q154R; Q71M+V82S+Y123H+Y147R+Q154R; E25F+V82S+Y123H+T133K+Y147R+Q154R; E25F+V82S+Y123H+Y147R+Q154R; V82S+Y123H+P124W+Y147R+Q154R; L51W+V82S+Y123H+C146R+Y147R+Q154R; P54C+V82S+Y123H+Y147R+Q154R; Y73S+V82S+Y123H+Y147R+Q154R; N38G+V82T+Y123H+Y147R+Q154R; R23H+V82S+Y123H+Y147R+Q154R; R21N+V82S+Y123H+Y147R+Q154R; V82S+Y123H+Y147R+Q154R+A158K; N72K+V82S+Y123H+D139L+Y147R+Q154R; E25F+V82S+Y123H+D139M+Y147R+Q154R; and M70V+V82S+M94V+Y123H+Y147R+Q154R In some embodiments, an adenosine deaminase comprises one or more of the following combinations of alterations: Q71M+V82S+Y123H+Y147R+Q154R; E25F+I76Y+V82S+Y123H+Y147R+Q154R; I76Y+V82T+Y123H+Y147R+Q154R; N38G+I76Y+V82S+Y123H+Y147R+Q154R; R23H+I76Y+V82S+Y123H+Y147R+Q154R; P54C+I76Y+V82S+Y123H+Y147R+Q154R; R21N+I76Y+V82S+Y123H+Y147R+Q154R; I76Y+V82S+Y123H+D139M+Y147R+Q154R; Y73S+I76Y+V82S+Y123H+Y147R+Q154R; E25F+I76Y+V82S+Y123H+Y147R+Q154R; I76Y+V82T+Y123H+Y147R+Q154R; N38G+I76Y+V82S+Y123H+Y147R+Q154R; R23H+I76Y+V82S+Y123H+Y147R+Q154R; P54C+I76Y+V82S+Y123H+Y147R+Q154R; R21N+I76Y+V82S+Y123H+Y147R+Q154R; I76Y+V82S+Y123H+D139M+Y147R+Q154R; Y73S+I76Y+V82S+Y123H+Y147R+Q154R; and V82S+Q154R; N72K_V82S+Y123H+Y147R+Q154R; Q71M_V82S+Y123H+Y147R+Q154R; V82S+Y123H+T133K+Y147R+Q154R; V82S+Y123H+T133K+Y147R+Q154R+A158K; M70V+Q71M+N72K+V82S+Y123H+Y147R+Q154R; N72K_V82S+Y123H+Y147R+Q154R; Q71M_V82S+Y123H+Y147R+Q154R; M70V+V82S+M94V+Y123H+Y147R+Q154R; V82S+Y123H+T133K+Y147R+Q154R; V82S+Y123H+T133K+Y147R+Q154R+A158K; and M70V+Q71M+N72K+V82S+Y123H+Y147R+Q154R. In some embodiments, the adenosine deaminase is expressed as a monomer. In other embodiments, the adenosine deaminase is expressed as a heterodimer. In some embodiments, the deaminase or other polypeptide sequence lacks a methionine, for example when included as a component of a fusion protein. This can alter the numbering of positions. However, the skilled person will understand that such corresponding mutations refer to the same mutation, e.g., Y73S and Y72S and D139M and D138M.

In some embodiments, the TadA*9 variant comprises the alterations described in Table 17 as described herein. In some embodiments, the TadA*9 variant is a monomer. In some embodiments, the TadA*9 variant is a heterodimer with a wild-type TadA adenosine deaminase. In some embodiments, the TadA*9 variant is a heterodimer with another TadA variant (e.g., TadA*8, TadA*9). Additional details of TadA*9 adenosine deaminases are described in International PCT Application No. PCT/2020/049975, which is incorporated herein by reference for its entirety.

Any of the mutations provided herein and any additional mutations (e.g., based on the ecTadA amino acid sequence) can be introduced into any other adenosine deaminases. Any of the mutations provided herein can be made individually or in any combination in TadA reference sequence or another adenosine deaminase (e.g., ecTadA).

Details of A to G nucleobase editing proteins are described in International PCT Application No. PCT/2017/045381 (WO2018/027078) and Gaudelli, N. M., et al., "Programmable base editing of A·T to G·C in genomic DNA without DNA cleavage" Nature, 551, 464-471 (2017), the entire contents of which are hereby incorporated by reference.

C to T Editing

In some embodiments, a base editor disclosed herein comprises a fusion protein comprising cytidine deaminase capable of deaminating a target cytidine (C) base of a polynucleotide to produce uridine (U), which has the base pairing properties of thymine. In some embodiments, for example where the polynucleotide is double-stranded (e.g., DNA), the uridine base can then be substituted with a thymidine base (e.g., by cellular repair machinery) to give rise to a C:G to a T:A transition. In other embodiments, deamination of a C to U in a nucleic acid by a base editor cannot be accompanied by substitution of the U to a T.

The deamination of a target C in a polynucleotide to give rise to a U is a non-limiting example of a type of base editing that can be executed by a base editor described herein. In another example, a base editor comprising a cytidine deaminase domain can mediate conversion of a cytosine (C) base to a guanine (G) base. For example, a U of a polynucleotide produced by deamination of a cytidine by a cytidine deaminase domain of a base editor can be excised from the polynucleotide by a base excision repair mechanism (e.g., by a uracil DNA glycosylase (UDG) domain), producing an abasic site. The nucleobase opposite the abasic site can then be substituted (e.g., by base repair machinery) with another base, such as a C, by for example a translesion polymerase. Although it is typical for a nucleobase opposite an abasic site to be replaced with a C, other substitutions (e.g., A, G or T) can also occur.

Accordingly, in some embodiments a base editor described herein comprises a deamination domain (e.g., cytidine deaminase domain) capable of deaminating a target C to a U in a polynucleotide. Further, as described below, the base editor can comprise additional domains which facilitate conversion of the U resulting from deamination to, in some embodiments, a T or a G. For example, a base editor comprising a cytidine deaminase domain can further comprise a uracil glycosylase inhibitor (UGI) domain to mediate substitution of a U by a T, completing a C-to-T base editing event. In another example, a base editor can incorporate a translesion polymerase to improve the efficiency of C-to-G base editing, since a translesion polymerase can facilitate incorporation of a C opposite an abasic site (i.e., resulting in incorporation of a G at the abasic site, completing the C-to-G base editing event).

A base editor comprising a cytidine deaminase as a domain can deaminate a target C in any polynucleotide, including DNA, RNA and DNA-RNA hybrids. Typically, a cytidine deaminase catalyzes a C nucleobase that is positioned in the context of a single-stranded portion of a polynucleotide. In some embodiments, the entire polynucleotide comprising a target C can be single-stranded. For example, a cytidine deaminase incorporated into the base editor can deaminate a target C in a single-stranded RNA polynucleotide. In other embodiments, a base editor comprising a cytidine deaminase domain can act on a double-stranded polynucleotide, but the target C can be positioned in a portion of the polynucleotide which at the time of the deamination reaction is in a single-stranded state. For example, in embodiments where the NAGPB domain comprises a Cas9 domain, several nucleotides can be left unpaired during formation of the Cas9-gRNA-target DNA complex, resulting in formation of a Cas9 "R-loop complex". These unpaired nucleotides can form a bubble of single-stranded DNA that can serve as a substrate for a single-strand specific nucleotide deaminase enzyme (e.g., cytidine deaminase).

In some embodiments, a cytidine deaminase of a base editor can comprise all or a portion of an apolipoprotein B mRNA editing complex (APOBEC) family deaminase. APOBEC is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. In some embodiments, a deaminase incorporated into a base editor comprises all or a portion of an APOBEC1 deaminase. In some embodiments, a deaminase incorporated into a base editor comprises all or a portion of APOBEC2 deaminase. In some embodiments, a deaminase incorporated into a base editor comprises all or a portion of is an APOBEC3 deaminase. In some embodiments, a deaminase incorporated into a base editor comprises all or a portion of an APOBEC3A deaminase. In some embodiments, a deaminase incorporated into a base editor comprises all or a portion of APOBEC3B deaminase. In some embodiments, a deaminase incorporated into a base editor comprises all or a portion of APOBEC3C deaminase. In some embodiments, a deaminase incorporated into a base editor comprises all or a portion of APOBEC3D deaminase. In some embodiments, a deaminase incorporated into a base editor comprises all or a portion of APOBEC3E deaminase. In some embodiments, a deaminase incorporated into a base editor comprises all or a portion of APOBEC3F deaminase. In some embodiments, a deaminase incorporated into a base editor comprises all or a portion of APOBEC3G deaminase. In some embodiments, a deaminase incorporated into a base editor comprises all or a portion of APOBEC3H deaminase. In some embodiments, a deaminase incorporated into a base editor comprises all or a portion of APOBEC4 deaminase. In some embodiments, a deaminase incorporated into a base editor comprises all or a portion of activation-induced deaminase (AID). In some embodiments a deaminase incorporated into a base editor comprises all or a portion of cytidine deaminase 1 (CDA1). It should be appreciated that a base editor can comprise a deaminase from any suitable organism (e.g., a human or a rat). In some embodiments, a deaminase domain of a base editor is from a human, chimpanzee, gorilla, monkey, cow, dog, rat, or mouse. In some embodiments, the deaminase domain of the base editor is derived from rat (e.g., rat APOBEC1). In some embodiments, the deaminase domain of the base editor is human APOBEC1. In some embodiments, the deaminase domain of the base editor is pmCDA1.

The amino acid and nucleic acid sequences of PmCDA1 are shown herein below.

```
tr|A5H718|A5H718_PETMA Cytosine deaminase OS = Petromyzon marinus
OX = 7757 PE = 2 SV = 1 amino acid sequence:
MTDAEYVRIHEKLDIYTFKKQFFNNKKSVSHRCYVLFELKRRGERRACFWGYAVNKPQSGTERG

IHAEIFSIRKVEEYLRDNPGQETINWYSSWSPCADCAEKILEWYNQELRGNGHTLKIWACKLYY

EKNARNQIGLWNLRDNGVGLNVMVSEHYQCCRKIFIQSSHNQLNENRWLEKTLKRAEKRRSELS

IMIQVKILHTTKSPAV

Nucleic acid sequence: >EF094822.1 Petromyzon marinus isolate PmCDA.21
cytosine deaminase mRNA, complete cds:
TGACACGACACAGCCGTGTATATGAGGAAGGGTAGCTGGATGGGGGGGGGGGGAATACGTTCAG

AGAGGACATTAGCGAGCGTCTTGTTGGTGGCCTTGAGTCTAGACACCTGCAGACATGACCGACG

CTGAGTACGTGAGAATCCATGAGAAGTTGGACATCTACACGTTTAAGAAACAGTTTTTCAACAA

CAAAAAATCCGTGTCGCATAGATGCTACGTTCTCTTTGAATTAAAACGACGGGGTGAACGTAGA

GCGTGTTTTTGGGGCTATGCTGTGAATAAACCACAGAGCGGGACAGAAAGTGGAATTCACGCCG

AAATCTTTAGCATTAGAAAAGTCGAAGAATACCTGCGCGACAACCCCGGACAATTCACGATAAA

TTGGTACTCATCCTGGAGTCCTTGTGCAGATTGCGCTGAAAAGATCTTAGAATGGTATAACCAG

GAGCTGCGGGGGAACGGCCACACTTTGAAAATCTGGGCTTGCAAACTCTATTACGAGAAAAATG

CGAGGAATCAAATTGGGCTGTGGAACCTCAGAGATAACGGGGTTGGGTTGAATGTAATGGTAAG

TGAACACTACCAATGTTGCAGGAAAATATTCATCCAATCGTCGCACAATCAATTGAATGAGAAT

AGATGGCTTGAGAAGACTTTGAAGCGAGCTGAAAAACGACGGAGCGAGTTGTCCATTATGATTC

AGGTAAAAATACTCCACACCACTAAGAGTCCTGCTGTTTAAGAGGCTATGCGGATGGTTTTC
```

The amino acid and nucleic acid sequences of the coding sequence (CDS) of human activation-induced cytidine deaminase (AID) are shown below.

```
>tr|Q6QJ80|Q6QJ80_HUMAN Activation-induced cytidine deaminase OS =
Homo sapiens OX = 9606 GN = AICDA PE = 2 SV = 1 amino acid sequence:
MDSLLMNRRKFLYQFKNVRWAKGRRETYLCYVVKRRDSATSFSLDFGYLRNKNGCHVELL
FLRYISDWDLDPGRCYRVTWFTSWSPCYDCARHVADFLRGNPNLSLRIFTARLYFCEDRK
AEPEGLRRLHRAGVQIAIMTFKAPV
```

The amino acid and nucleic acid sequences of the coding sequence (CDS) of human activation-induced cytidine deaminase (AID) are shown below.

```
>tr|Q6QJ80|Q6QJ80_HUMAN Activation-induced cytidine deaminase OS = Homo sapiens
OX = 9606 GN = AICDA PE = 2 SV = 1 amino acid sequence:
MDSLLMNRRKFLYQFKNVRWAKGRRETYLCYVVKRRDSATSFSLDFGYLRNKNGCHVELL

FLRYISDWDLDPGRCYRVTWFTSWSPCYDCARHVADFLRGNPNLSLRIFTARLYFCEDRK

AEPEGLRRLHRAGVQIAIMTFKAPV

Nucleic acid sequence: >NG_011588.1:5001-15681 Homo sapiens activation induced
cytidine deaminase (AICDA), RefSeqGene (LRG_17) on chromosome 12:
AGAGAACCATCATTAATTGAAGTGAGATTTTTCTGGCCTGAGACTTGCAGGGAGGCAAGAAGAC

ACTCTGGACACCACTATGGACAGGTAAAGAGGCAGTCTTCTCGTGGGTGATTGCACTGGCCTTC

CTCTCAGAGCAAATCTGAGTAATGAGACTGGTAGCTATCCCTTTCTCTCATGTAACTGTCTGAC

TGATAAGATCAGCTTGATCAATATGCATATATATTTTTTGATCTGTCTCCTTTTCTTCTATTCA

GATCTTATACGCTGTCAGCCCAATTCTTTCTGTTTCAGACTTCTCTTGATTTCCCTCTTTTTCA

TGTGGCAAAAGAAGTAGTGCGTACAATGTACTGATTCGTCCTGAGATTTGTACCATGGTTGAAA

CTAATTTATGGTAATAATATTAACATAGCAAATCTTTAGAGACTCAAATCATGAAAAGGTAATA

GCAGTACTGTACTAAAAACGGTAGTGCTAATTTTCGTAATAATTTTGTAAATATTCAACAGTAA

AACAACTTGAAGACACACTTTCCTAGGGAGGCGTTACTGAAATAATTTAGCTATAGTAAGAAAA

TTTGTAATTTTAGAAATGCCAAGCATTCTAAATTAATTGCTTGAAAGTCACTATGATTGTGTCC

ATTATAAGGAGACAAATTCATTCAAGCAAGTTATTTAATGTTAAAGGCCCAATTGTTAGGCAGT

TAATGGCACTTTTACTATTAACTAATCTTTCCATTTGTTCAGACGTAGCTTAACTTACCTCTTA

GGTGTGAATTTGGTTAAGGTCCTCATAATGTCTTTATGTGCAGTTTTTGATAGGTTATTGTCAT

AGAACTTATTCTATTCCTACATTTATGATTACTATGGATGTATGAGAATAACACCTAATCCTTA

TACTTTACCTCAATTTAACTCCTTTATAAAGAACTTACATTACAGAATAAAGATTTTTTAAAAA

TATATTTTTTTGTAGAGACAGGGTCTTAGCCCAGCCGAGGCTGGTCTCTAAGTCCTGGCCCAAG

CGATCCTCCTGCCTGGGCCTCCTAAAGTGCTGGAATTATAGACATGAGCCATCACATCCAATAT

ACAGAATAAAGATTTTTAATGGAGGATTTAATGTTCTTCAGAAAATTTTCTTGAGGTCAGACAA

TGTCAAATGTCTCCTCAGTTTACACTGAGATTTTGAAAACAAGTCTGAGCTATAGGTCCTTGTG

AAGGGTCCATTGGAAATACTTGTTCAAAGTAAAATGGAAAGCAAAGGTAAAATCAGCAGTTGAA

ATTCAGAGAAAGACAGAAAAGGAGAAAAGATGAAATTCAACAGGACAGAAGGGAAATATATTAT

CATTAAGGAGGACAGTATCTGTAGAGCTCATTAGTGATGGCAAAATGACTTGGTCAGGATTATT

TTTAACCCGCTTGTTTCTGGTTTGCACGGCTGGGGATGCAGCTAGGGTTCTGCCTCAGGGAGCA

CAGCTGTCCAGAGCAGCTGTCAGCCTGCAAGCCTGAAACACTCCCTCGGTAAAGTCCTTCCTAC

TCAGGACAGAAATGACGAGAACAGGGAGCTGGAAACAGGCCCCTAACCAGAGAAGGGAAGTAAT

GGATCAACAAAGTTAACTAGCAGGTCAGGATCACGCAATTCATTTCACTCTGACTGGTAACATG

TGACAGAAACAGTGTAGGCTTATTGTATTTTCATGTAGAGTAGGACCCAAAAATCCACCCAAAG

TCCTTTATCTATGCCACATCCTTCTTATCTATACTTCCAGGACACTTTTTCTTCCTTATGATAA

GGCTCTCTCTCTCTCCACACACACACACACACACACACACACACACACACACACACACAAAC

ACACACCCCGCCAACCAAGGTGCATGTAAAAAGATGTAGATTCCTCTGCCTTTCTCATCTACAC

AGCCCAGGAGGGTAAGTTAATATAAGAGGGATTTATTGGTAAGAGATGATGCTTAATCTGTTTA

ACACTGGGCCTCAAAGAGAGAATTTCTTTTCTTCTGTACTTATTAAGCACCTATTATGTGTTGA

GCTTATATATACAAAGGGTTATTATATGCTAATATAGTAATAGTAATGGTGGTTGGTACTATGG
```

-continued

```
TAATTACCATAAAAATTATTATCCTTTTAAAATAAAGCTAATTATTATTGGATCTTTTTTAGTA

TTCATTTTATGTTTTTTATGTTTTTGATTTTTTAAAAGACAATCTCACCCTGTTACCCAGGCTG

GAGTGCAGTGGTGCAATCATAGCTTTCTGCAGTCTTGAACTCCTGGGCTCAAGCAATCCTCCTG

CCTTGGCCTCCCAAAGTGTTGGGATACAGTCATGAGCCACTGCATCTGGCCTAGGATCCATTTA

GATTAAAATATGCATTTTAAATTTTAAAATAATATGGCTAATTTTTACCTTATGTAATGTGTAT

ACTGGCAATAAATCTAGTTTGCTGCCTAAAGTTTAAAGTGCTTTCCAGTAAGCTTCATGTACGT

GAGGGGAGACATTTAAAGTGAAACAGACAGCCAGGTGTGGTGGCTCACGCCTGTAATCCCAGCA

CTCTGGGAGGCTGAGGTGGGTGGATCGCTTGAGCCCTGGAGTTCAAGACCAGCCTGAGCAACAT

GGCAAAACGCTGTTTCTATAACAAAAATTAGCCGGGCATGGTGGCATGTGCCTGTGGTCCCAGC

TACTAGGGGGCTGAGGCAGGAGAATCGTTGGAGCCCAGGAGGTCAAGGCTGCACTGAGCAGTGC

TTGCGCCACTGCACTCCAGCCTGGGTGACAGGACCAGACCTTGCCTCAAAAAAATAAGAAGAAA

AATTAAAAATAAATGGAAACAACTACAAAGAGCTGTTGTCCTAGATGAGCTACTTAGTTAGGCT

GATATTTTGGTATTTAACTTTTAAAGTCAGGGTCTGTCACCTGCACTACATTATTAAAATATCA

ATTCTCAATGTATATCCACACAAAGACTGGTACGTGAATGTTCATAGTACCTTTATTCACAAAA

CCCCAAAGTAGAGACTATCCAAATATCCATCAACAAGTGAACAAATAAACAAAATGTGCTATAT

CCATGCAATGGAATACCACCCTGCAGTACAAAGAAGCTACTTGGGGATGAATCCCAAAGTCATG

ACGCTAAATGAAAGAGTCAGACATGAAGGAGGAGATAATGTATGCCATACGAAATTCTAGAAAA

TGAAAGTAACTTATAGTTACAGAAAGCAAATCAGGGCAGGCATAGAGGCTCACACCTGTAATCC

CAGCACTTTGAGAGGCCACGTGGGAAGATTGCTAGAACTCAGGAGTTCAAGACCAGCCTGGGCA

ACACAGTGAAACTCCATTCTCCACAAAAATGGGAAAAAAAGAAAGCAAATCAGTGGTTGTCCTG

TGGGGAGGGGAAGGACTGCAAAGAGGGGAAGAAGCTCTGGTGGGGTGAGGGTGGTGATTCAGGTT

CTGTATCCTGACTGTGGTAGCAGTTTGGGGTGTTTACATCCAAAAATATTCGTAGAATTATGCA

TCTTAAATGGGTGGAGTTTACTGTATGTAAATTATACCTCAATGTAAGAAAAAATAATGTGTAA

GAAAACTTTCAATTCTCTTGCCAGCAAACGTTATTCAAATTCCTGAGCCCTTTACTTCGCAAAT

TCTCTGCACTTCTGCCCCGTACCATTAGGTGACAGCACTAGCTCCACAAATTGGATAAATGCAT

TTCTGGAAAAGACTAGGGACAAAATCCAGGCATCACTTGTGCTTTCATATCAACCATGCTGTAC

AGCTTGTGTTGCTGTCTGCAGCTGCAATGGGGACTCTTGATTTCTTTAAGGAAACTTGGGTTAC

CAGAGTATTTCCACAAATGCTATTCAAATTAGTGCTTATGATATGCAAGACACTGTGCTAGGAG

CCAGAAAACAAAGAGGAGGAGAAATCAGTCATTATGTGGGAACAACATAGCAAGATATTTAGAT

CATTTTGACTAGTTAAAAAAGCAGCAGAGTACAAAATCACACATGCAATCAGTATAATCCAAAT

CATGTAAATATGTGCCTGTAGAAAGACTAGAGGAATAAACACAAGAATCTTAACAGTCATTGTC

ATTAGACACTAAGTCTAATTATTATTATTAGACACTATGATATTTGAGATTTAAAAAATCTTTA

ATATTTAAAATTTAGAGCTCTTCTATTTTTCCATAGTATTCAAGTTTGACAATGATCAAGTAT

TACTCTTTCTTTTTTTTTTTTTTTTTTTTTTTTTTGAGATGGAGTTTTGGTCTTGTTGCCCATGC

TGGAGTGGAATGGCATGACCATAGCTCACTGCAACCTCCACCTCCTGGGTTCAAGCAAAGCTGT

CGCCTCAGCCTCCCGGGTAGATGGGATTACAGGCGCCCACCACCACACTCGGCTAATGTTTGTA

TTTTTAGTAGAGATGGGGTTTCACCCATGTTGGCCAGGCTGGTCTCAAACTCCTGACCTCAGAGG

ATCCACCTGCCTCAGCCTCCCAAAGTGCTGGGATTACAGATGTAGGCCACTGCGCCCGGCCAAG

TATTGCTCTTATACATTAAAAAACAGGTGTGAGCCACTGCGCCCAGCCAGGTATTGCTCTTATA

CATTAAAAAATAGGCCGGTGCAGTGGCTCACGCCTGTAATCCCAGCACTTTGGGAAGCCAAGGC

GGGCAGAACACCCGAGGTCAGGAGTCCAAGGCCAGCCTGGCCAAGATGGTGAAACCCCGTCTCT
```

-continued

```
ATTAAAAATACAAACATTACCTGGGCATGATGGTGGGCGCCTGTAATCCCAGCTACTCAGGAGG

CTGAGGCAGGAGGATCCGCGGAGCCTGGCAGATCTGCCTGAGCCTGGGAGGTTGAGGCTACAGT

AAGCCAAGATCATGCCAGTATACTTCAGCCTGGGCGACAAAGTGAGACCGTAACAAAAAAAAA

AAATTTAAAAAAAGAAATTTAGATCAAGATCCAACTGTAAAAAGTGGCCTAAACACCACATTAA

AGAGTTTGGAGTTTATTCTGCAGGCAGAAGAGAACCATCAGGGGGTCTTCAGCATGGGAATGGC

ATGGTGCACCTGGTTTTTGTGAGATCATGGTGGTGACAGTGTGGGGAATGTTATTTTGGAGGGA

CTGGAGGCAGACAGACCGGTTAAAAGGCCAGCACAACAGATAAGGAGGAAGAAGATGAGGGCTT

GGACCGAAGCAGAGAAGAGCAAACAGGGAAGGTACAAATTCAAGAAATATTGGGGGGTTTGAAT

CAACACATTTAGATGATTAATTAAATATGAGGACTGAGGAATAAGAAATGAGTCAAGGATGGTT

CCAGGCTGCTAGGCTGCTTACCTGAGGTGGCAAAGTCGGGAGGAGTGGCAGTTTAGGACAGGGG

GCAGTTGAGGAATATTGTTTTGATCATTTTGAGTTTGAGGTACAAGTTGGACACTTAGGTAAAG

ACTGGAGGGGAAATCTGAATATACAATTATGGGACTGAGGAACAAGTTTATTTTATTTTTTGTT

TCGTTTTCTTGTTGAAGAACAAATTTAATTGTAATCCCAAGTCATCAGCATCTAGAAGACAGTG

GCAGGAGGTGACTGTCTTGTGGGTAAGGGTTTGGGGTCCTTGATGAGTATCTCTCAATTGGCCT

TAAATATAAGCAGGAAAAGGAGTTTATGATGGATTCCAGGCTCAGCAGGGCTCAGGAGGGCTCA

GGCAGCCAGCAGAGGAAGTCAGAGCATCTTCTTTGGTTTAGCCCAAGTAATGACTTCCTTAAAA

AGCTGAAGGAAAATCCAGAGTGACCAGATTATAAACTGTACTCTTGCATTTTCTCTCCCTCCTC

TCACCCACAGCCTCTTGATGAACCGGAGGAAGTTTCTTTACCAATTCAAAAATGTCCGCTGGGC

TAAGGGTCGGCGTGAGACCTACCTGTGCTACGTAGTGAAGAGGCGTGACAGTGCTACATCCTTT

TCACTGGACTTTGGTTATCTTCGCAATAAGGTATCAATTAAAGTCGGCTTTGCAAGCAGTTTAA

TGGTCAACTGTGAGTGCTTTTAGAGCCACCTGCTGATGGTATTACTTCCATCCTTTTTTGGCAT

TTGTGTCTCTATCACATTCCTCAAATCCTTTTTTTTATTTCTTTTTCCATGTCCATGCACCCAT

ATTAGACATGGCCCAAAATATGTGATTTAATTCCTCCCCAGTAATGCTGGGCACCCTAATACCA

CTCCTTCCTTCAGTGCCAAGAACAACTGCTCCCAAACTGTTTACCAGCTTTCCTCAGCATCTGA

ATTGCCTTTGAGATTAATTAAGCTAAAAGCATTTTTATATGGGAGAATATTATCAGCTTGTCCA

AGCAAAAATTTTAAATGTGAAAAACAAATTGTGTCTTAAGCATTTTTGAAAATTAAGGAAGAAG

AATTTGGGAAAAAATTAACGGTGGCTCAATTCTGTCTTCCAAATGATTTCTTTTCCCTCCTACT

CACATGGGTCGTAGGCCAGTGAATACATTCAACATGGTGATCCCCAGAAAACTCAGAGAAGCCT

CGGCTGATGATTAATTAAATTGATCTTTCGGCTACCCGAGAGAATTACATTTCCAAGAGACTTC

TTCACCAAAATCCAGATGGGTTTACATAAACTTCTGCCCACGGGTATCTCCTCTCTCCTAACAC

GCTGTGACGTCTGGGCTTGGTGGAATCTCAGGGAAGCATCCGTGGGGTGGAAGGTCATCGTCTG

GCTCGTTGTTTGATGGTTATATTACCATGCAATTTTCTTTGCCTACATTTGTATTGAATACATC

CCAATCTCCTTCCTATTCGGTGACATGACACATTCTATTTCAGAAGGCTTTGATTTTATCAAGC

ACTTTCATTTACTTCTCATGGCAGTGCCTATTACTTCTCTTACAATACCCATCTGTCTGCTTTA

CCAAAATCTATTTCCCCTTTTCAGATCCTCCCAAATGGTCCTCATAAACTGTCCTGCCTCCACC

TAGTGGTCCAGGTATATTTCCACAATGTTACATCAACAGGCACTTCTAGCCATTTTCCTTCTCA

AAAGGTGCAAAAAGCAACTTCATAAACACAAATTAAATCTTCGGTGAGGTAGTGTGATGCTGCT

TCCTCCCAACTCAGCGCACTTCGTCTTCCTCATTCCACAAAAACCCATAGCCTTCCTTCACTCT

GCAGGACTAGTGCTGCCAAGGGTTCAGCTCTACCTACTGGTGTGCTCTTTTGAGCAAGTTGCTT

AGCCTCTCTGTAACACAAGGACAATAGCTGCAAGCATCCCCAAAGATCATTGCAGGAGACAATG
```

-continued

```
ACTAAGGCTACCAGAGCCGCAATAAAAGTCAGTGAATTTTAGCGTGGTCCTCTCTGTCTCTCCA

GAACGGCTGCCACGTGGAATTGCTCTTCCTCCGCTACATCTCGGACTGGGACCTAGACCCTGGC

CGCTGCTACCGCGTCACCTGGTTCACCTCCTGGAGCCCCTGCTACGACTGTGCCCGACATGTGG

CCGACTTTCTGCGAGGGAACCCCAACCTCAGTCTGAGGATCTTCACCGCGCGCCTCTACTTCTG

TGAGGACCGCAAGGCTGAGCCCGAGGGGCTGCGGCGGCTGCACCGCGCCGGGGTGCAAATAGCC

ATCATGACCTTCAAAGGTGCGAAAGGGCCTTCCGCGCAGGCGCAGTGCAGCAGCCCGCATTCGG

GATTGCGATGCGGAATGAATGAGTTAGTGGGGAAGCTCGAGGGGAAGAAGTGGGCGGGGATTCT

GGTTCACCTCTGGAGCCGAAATTAAAGATTAGAAGCAGAGAAAAGAGTGAATGGCTCAGAGACA

AGGCCCCGAGGAAATGAGAAAATGGGGCCAGGGTTGCTTCTTTCCCCTCGATTTGGAACCTGAA

CTGTCTTCTACCCCCATATCCCCGCCTTTTTTTCCTTTTTTTTTTTTTGAAGATTATTTTTACT

GCTGGAATACTTTTGTAGAAAACCACGAAAGAACTTTCAAAGCCTGGGAAGGGCTGCATGAAAA

TTCAGTTCGTCTCTCCAGACAGCTTCGGCGCATCCTTTTGGTAAGGGGCTTCCTCGCTTTTTAA

ATTTTCTTTCTTTCTCTACAGTCTTTTTTGGAGTTTCGTATATTTCTTATATTTTCTTATTGTT

CAATCACTCTCAGTTTTCATCTGATGAAACTTTATTTCTCCTCCACATCAGCTTTTTCTTCTG

CTGTTTCACCATTCAGAGCCCTCTGCTAAGGTTCCTTTTCCCTCCCTTTTCTTTCTTTTGTTGT

TTCACATCTTTAAATTTCTGTCTCTCCCCAGGGTTGCGTTTCCTTCCTGGTCAGAATTCTTTTC

TCCTTTTTTTTTTTTTTTTTTTTTTTTTTTAAACAAACAAACAAAAAACCCAAAAAAACTCTTT

CCCAATTTACTTTCTTCCAACATGTTACAAAGCCATCCACTCAGTTTAGAAGACTCTCCGGCCC

CACCGACCCCCAACCTCGTTTTGAAGCCATTCACTCAATTTGCTTCTCTCTTTCTCTACAGCCC

CTGTATGAGGTTGATGACTTACGAGACGCATTTCGTACTTTGGGACTTTGATAGCAACTTCCAG

GAATGTCACACACGATGAAATATCTCTGCTGAAGACAGTGGATAAAAAACAGTCCTTCAAGTCT

TCTCTGTTTTTATTCTTCAACTCTCACTTTCTTAGAGTTTACAGAAAAAATATTTATATACGAC

TCTTTAAAAAGATCTATGTCTTGAAAATAGAGAAGGAACACAGGTCTGGCCAGGGACGTGCTGC

AATTGGTGCAGTTTTGAATGCAACATTGTCCCCTACTGGGAATAACAGAACTGCAGGACCTGGG

AGCATCCTAAAGTGTCAACGTTTTTCTATGACTTTTAGGTAGGATGAGAGCAGAAGGTAGATCC

TAAAAAGCATGGTGAGAGGATCAAATGTTTTTATATCAACATCCTTTATTATTTGATTCATTTG

AGTTAACAGTGGTGTTAGTGATAGATTTTTCTATTCTTTTCCCTTGACGTTTAGTTTCAAGTAA

CACAAACTCTTCCATCAGGCCATGATCTATAGGACCTCCTAATGAGAGTATCTGGGTGATTGTG

ACCCCAAACCATCTCTCCAAAGCATTAATATCCAATCATGCGCTGTATGTTTTAATCAGCAGAA

GCATGTTTTTATGTTTGTACAAAAGAAGATTGTTATGGGTGGGGATGGAGGTATAGACCATGCA

TGGTCACCTTCAAGCTACTTTAATAAAGGATCTTAAAATGGGCAGGAGGACTGTGAACAAGACA

CCCTAATAATGGGTTGATGTCTGAAGTAGCAAATCTTCTGGAAACGCAAACTCTTTTAAGGAAG

TCCCTAATTTAGAAACACCCACAAACTTCACATATCATAATTAGCAAACAATTGGAAGGAAGTT

GCTTGAATGTTGGGGAGAGGAAAATCTATTGGCTCTCGTGGGTCTCTTCATCTCAGAAATGCCA

ATCAGGTCAAGGTTTGCTACATTTTGTATGTGTGTGATGCTTCTCCCAAAGGTATATTAACTAT

ATAAGAGAGTTGTGACAAAACAGAATGATAAAGCTGCGAACCGTGGCACACGCTCATAGTTCTA

GCTGCTTGGGAGGTTGAGGAGGGAGGATGGCTTGAACACAGGTGTTCAAGGCCAGCCTGGGCAA

CATAACAAGATCCTGTCTCTCAAAAAAAAAAAAAAAAAAAAAGAAAGAGAGAGGGCCGGGCGTGG

TGGCTCACGCCTGTAATCCCAGCACTTTGGGAGGCCGAGCCGGGCGGATCACCTGTGGTCAGGA

GTTTGAGACCAGCCTGGCCAACATGGCAAAACCCCGTCTGTACTCAAAATGCAAAAATTAGCCA

GGCGTGGTAGCAGGCACCTGTAATCCCAGCTACTTGGGAGGCTGAGGCAGGAGAATCGCTTGAA
```

-continued

CCCAGGAGGTGGAGGTTGCAGTAAGCTGAGATCGTGCCGTTGCACTCCAGCCTGGGCGACAAGA

GCAAGACTCTGTCTCAGAAAAAAAAAAAAAAAAAGAGAGAGAGAGAGAAAGAGAACAATATTTGG

GAGAGAAGGATGGGGAAGCATTGCAAGGAAATTGTGCTTTATCCAACAAAATGTAAGGAGCCAA

TAAGGGATCCCTATTTGTCTCTTTTGGTGTCTATTTGTCCCTAACAACTGTCTTTGACAGTGAG

AAAAATATTCAGAATAACCATATCCCTGTGCCGTTATTACCTAGCAACCCTTGCAATGAAGATG

AGCAGATCCACAGGAAAACTTGAATGCACAACTGTCTTATTTTAATCTTATTGTACATAAGTTT

GTAAAAGAGTTAAAAATTGTTACTTCATGTATTCATTTATATTTTATATTATTTTGCGTCTAAT

GATTTTTTATTAACATGATTTCCTTTTCTGATATATTGAAATGGAGTCTCAAAGCTTCATAAAT

TTATAACTTTAGAAATGATTCTAATAACAACGTATGTAATTGTAACATTGCAGTAATGGTGCTA

CGAAGCCATTTCTCTTGATTTTTAGTAAACTTTTATGACAGCAAATTTGCTTCTGGCTCACTTT

CAATCAGTTAAATAAATGATAAATAATTTTGGAAGCTGTGAAGATAAAATACCAAATAAAATAA

TATAAAAGTGATTTATATGAAGTTAAAATAAAAAATCAGTATGATGGAATAAACTTG

Other exemplary deaminases that can be fused to Cas9 according to aspects of this disclosure are provided below. In embodiments, the deaminases are activation-induced deaminases (AID). It should be understood that, in some embodiments, the active domain of the respective sequence can be used, e.g., the domain without a localizing signal (nuclear localization sequence, without nuclear export signal, cytoplasmic localizing signal).

```
Human AID:
                                                      (SEQ ID NO: 1372)
MDSLLMNRRKFLYQFKNVRWAKGRRETYLCYVVKRRDSATSFSLDFGYLRNKNGCHVELLFLRY

ISDWDLDPGRCYRVTWFTSWSPCYDCARHVADFLRGNPNLSLRIFTARLYFCEDRKAEPEGLRR

LHRAGVQIAIMTFKDYFYCWNTFVENHERTFKAWEGLHENSVRLSRQLRRILLPLYEVDDLRDA

FRTLGL (underline: nuclear localization sequence; double underline: nuclear export signal)

Mouse AID:
                                                      (SEQ ID NO: 1373)
MDSLLMKQKKFLYHFKNVRWAKGRHETYLCYVVKRRDSATSCSLDFGHLRNKSGCHVELLFLRY

ISDWDLDPGRCYRVTWFTSWSPCYDCARHVAEFLRWNPNLSLRIFTARLYFCEDRKAEPEGLRR

LHRAGVQIGIMTFKDYFYCWNTFVENRERTFKAWEGLHENSVRLTRQLRRILLPLYEVDDLRDA

FRMLGF (underline: nuclear localization sequence; double underline: nuclear export signal)

Canine AID:
                                                      (SEQ ID NO: 1374)
MDSLLMKQRKFLYHFKNVRWAKGRHETYLCYVVKRRDSATSFSLDFGHLRNKSGCHVELLFLRY

ISDWDLDPGRCYRVTWFTSWSPCYDCARHVADFLRGYPNLSLRIFAARLYFCEDRKAEPEGLRR

LHRAGVQIAIMTFKDYFYCWNTFVENREKTFKAWEGLHENSVRLSRQLRRILLPLYEVDDLRDA

FRTLGL (underline: nuclear localization sequence; double underline: nuclear export signal)

Bovine AID:
                                                      (SEQ ID NO: 1375)
MDSLLKKQRQFLYQFKNVRWAKGRHETYLCYVVKRRDSPTSFSLDFGHLRNKAGCHVELLFLRY

ISDWDLDPGRCYRVTWFTSWSPCYDCARHVADFLRGYPNLSLRIFTARLYFCDKERKAEPEGLR

RLHRAGVQIAIMTEKDYFYCWNTFVENHERTFKAWEGLHENSVRLSRQLRRILLPLYEVDDLRD

AFRTLGL (underline: nuclear localization sequence; double underline: nuclear export signal)
```

-continued

Rat AID:

(SEQ ID NO: 1376)

MAVGSKPKAALVGPHWERERIWCFLCSTGLGTQQTGQTSRWLRPAATQDPVSPPRSLLMKQRKE

LYHFKNVRWAKGRHETYLCYVVKRRDSATSFSLDFGYLRNKSGCHVELLFLRYISDWDLDPGRC

YRVTWFTSWSPCYDCARHVADFLRGNPNLSLRIFTARLTGWGALPAGLMSPARPSDYFYCWNTF

VENHERTFKAWEGLHENSVRLSRRLRRILLPLYEVDDLRDAFRTLGL (underline: nuclear localization sequence; double underline: nuclear export signal)

clAID (Canis lupus familiaris):

(SEQ ID NO: 1374)

MDSLLMKQRKFLYHFKNVRWAKGRHETYLCYVVKRRDSATSFSLDFGHLRNKSGCHVELLFLRYISDWDL

DPGRCYRVTWFTSWSPCYDCARHVADFLRGYPNLSLRIFAARLYFCEDRKAEPEGLRRLHRAGVQIAIMT

FKDYFYCWNTFVENREKTFKAWEGLHENSVRLSRQLRRILLPLYEVDDLRDAFRTLGL btAID (Bos Taurus):

(SEQ ID NO: 1375)

MDSLLKKQRQFLYQFKNVRWAKGRHETYLCYVVKRRDSPTSFSLDFGHLRNKAGCHVELLFLRYISDWDL

DPGRCYRVTWFTSWSPCYDCARHVADFLRGYPNLSLRIFTARLYFCDKERKAEPEGLRRLHRAGVQIAIM

TFKDYFYCWNTFVENHERTFKAWEGLHENSVRLSRQLRRILLPLYEVDDLRDAFRTLGL mAID (Mus musculus):

(SEQ ID NO: 1377)

MDSLLMNRRKFLYQFKNVRWAKGRRETYLCYVVKRRDSATSFSLDFGYLRNKNGCHVELLFLRYISDWDL

DPGRCYRVTWFTSWSPCYDCARHVADFLRGNPNLSLRIFTARLYFCEDRKAEPEGLRRLHRAGVQIAIMT

FKDYFYCWNTFVENHERTFKAWEGLHENSVRLSRQLRRILLPLYEVDDLRDAFRTLGL rAPOBEC-1 (Rattus norvegicus):

(SEQ ID NO: 1378)

MSSETGPVAVDPTLRRRIEPHEFEVFFDPRELRKETCLLYEINWGGRHSIWRHTSQNTNKHVEVNFIEKE

TTERYFCPNTRCSITWFLSWSPCGECSRAITEFLSRYPHVTLFIYIARLYHHADPRNRQGLRDLISSGVT

IQIMTEQESGYCWRNFVNYSPSNEAHWPRYPHLWVRLYVLELYCIILGLPPCLNILRRKQPQLTFFTIAL

QSCHYQRLPPHILWATGLK maAPOBEC-1 (Mesocricetus auratus):

(SEQ ID NO: 1379)

MSSETGPVVVDPTLRRRIEPHEFDAFFDQGELRKETCLLYEIRWGGRHNIWRHTGQNTSRHVEINFIEKF

TSERYFYPSTRCSIVWFLSWSPCGECSKAITEFLSGHPNVTLFIYAARLYHHTDQRNRQGLRDLISRGVT

IRIMTEQEYCYCWRNFVNYPPSNEVYWPRYPNLWMRLYALELYCIHLGLPPCLKIKRRHQYPLTFFRLNL

QSCHYQRIPPHILWATGFI ppAPOBEC-1 (Pongo pygmaeus):

(SEQ ID NO: 1380)

MTSEKGPSTGDPTLRRRIESWEFDVFYDPRELRKETCLLYEIKWGMSRKIWRSSGKNTTNHVEVNFIKKF

TSERRFHSSISCSITWFLSWSPCWECSQAIREFLSQHPGVTLVIYVARLFWHMDQRNRQGLRDLVNSGVT

IQIMRASEYYHCWRNFVNYPPGDEAHWPQYPPLWMMLYALELHCIILSLPPCLKISRRWQNHLAFFRLHL

QNCHYQTIPPHILLATGLIHPSVTWR ocAPOBEC 1(Oryctolagus cuniculus):

(SEQ ID NO: 1381)

MASEKGPSNKDYTLRRRIEPWEFEVFFDPQELRKEACLLYEIKWGASSKTWRSSGKNTTNHVEVNFLEKL

TSEGRLGPSTCCSITWFLSWSPCWECSMAIREFLSQHPGVTLIIFVARLFQHMDRRNRQGLKDLVTSGVT

VRVMSVSEYCYCWENFVNYPPGKAAQWPRYPPRWMLMYALELYCIILGLPPCLKISRRHQKQLTFFSLTP

QYCHYKMIPPYILLATGLLQPSVPWR mdAPOBEC-1 (Monodelphis domestica):

(SEQ ID NO: 1382)

MNSKTGPSVGDATLRRRIKPWEFVAFFNPQELRKETCLLYEIKWGNQNIWRHSNQNTSQHAEINFMEKFT

AERHFNSSVRCSITWFLSWSPCWECSKAIRKFLDHYPNVTLAIFISRLYWHMDQQHRQGLKELVHSGVTI

-continued

QIMSYSEYHYCWRNFVDYPQGEEDYWPKYPYLWIMLYVLELHCIILGLPPCLKISGSHSNQLALFSLDLQ

DCHYQKIPYNVLVATGLVQPFVTWR ppAPOBEC-2 (*Pongo pygmaeus*):

(SEQ ID NO: 1383)

MAQKEEAAAATEAASQNGEDLENLDDPEKLKELIELPPFEIVTGERLPANFFKFQFRNVEYSSGRNKTFL

CYVVEAQGKGGQVQASRGYLEDEHAAAHAEEAFFNTILPAFDPALRYNVTWYVSSSPCAACADRIIKTLS

KTKNLRLLILVGRLFMWEELEIQDALKKLKEAGCKLRIMKPQDFEYVWQNFVEQEEGESKAFQPWEDIQE

NFLYYEEKLADILK btAPOBEC-2 (*Bos Taurus*):

(SEQ ID NO: 1384)

MAQKEEAAAAAEPASQNGEEVENLEDPEKLKELIELPPFEIVTGERLPAHYFKFQFRNVEYSSGRNKTFL

CYVVEAQSKGGQVQASRGYLEDEHATNHAEEAFFNSIMPTFDPALRYMVTWYVSSSPCAACADRIVKTLN

KTKNLRLLILVGRLFMWEEPEIQAALRKLKEAGCRLRIMKPQDFEYIWQNFVEQEEGESKAFEPWEDIQE

NFLYYEEKLADILK mAPOBEC-3-(1) (*Mus musculus*):

(SEQ ID NO: 1385)

MQPQRLGPRAGMGPFCLGCSHRKCYSPIRNLISQETFKFHFKNLGYAKGRKDTFLCYEVTRKDCDSPVSL

HHGVFKNKDNIHAEICFLYWFHDKVLKVLSPREEFKITWYMSWSPCFECAEQIVRFLATHHNLSLDIFSS

RLYNVQDPETQQNLCRLVQEGAQVAAMDLYEFKKCWKKFVDNGGRRFRPWKRLLTNFRYQDSKLQEILRP

CYISVPSSSSSTLSNICLTKGLPETRFWVEGRRMDPLSEEEFYSQFYNQRVKHLCYYHRMKPYLCYQLEQ

FNGQAPLKGCLLSEKGKQHAEILFLDKIRSMELSQVTITCYLTWSPCPNCAWQLAAFKRDRPDLILHIYT

SRLYFHWKRPFQKGLCSLWQSGILVDVMDLPQFTDCWTNFVNPKRPFWPWKGLEIISRRTQRRLRRIKES

WGLQDLVNDFGNLQLGPPMS

Mouse APOBEC-3-(2):

(SEQ ID NO: 1386)

MGPFCLGCSHRKCYSPIRNLISQETFKFHFKNLGYAKGRKDTFLCYEVTRKDCDSPVSLHHGVFKNKDNI

*HAEICFLYWFHDKVLKVLSPREEFKITWYMSWSPCFEC*AEQIVRFLATHHNLSLDIFSSRLYNVQDPETQ

QNLCRLVQEGAQVAAMDLYEFKKCWKKFVDNGGRRFRPWKRLLTNFRYQDSKLQEILRPCYIPVPSSSSS

TLSNICLTKGLPETRFCVEGRRMDPLSEEEFYSQFYNQRVKHLCYYHRMKPYLCYQLEQFNGQAPLKGCL

LSEKGKQ*HAEILFLDKIRSMELSQVTITCYLTWSPCPNC*AWQLAAFKRDRPDLILHIYTSRLYFHWKRPF

QKGLCSLWQSGILVDVMDLPQFTDCWTNFVNPKRPFWPWKGLEIISRRTQRRLRRIKESWGLQDLVNDFG

NLQLGPPMS (italic: nucleic acid editing domain)

Rat APOBEC-3:

(SEQ ID NO: 1387)

MGPFCLGCSHRKCYSPIRNLISQETFKFHFKNRLRYAIDRKDTFLCYEVTRKDCDSPVSLHHGVFKNKDN

I*HAEICFLYWFHDKVLRVLSPREEFKITWYMSWSPCFEC*AEQVLRFLATHHNLSLDIFSSRLYNIRDPEN

QQNLCRLVQEGAQVAAMDLYEFKKCWKKFVDNGGRRFRPWKKLLTNFRYQDSKLQEILRPCYIPVPSSSS

STLSNICLTKGLPETRFCVERRVHLLSEEEFYSQFYNQRVKHLCYYHGVKPYLCYQLEQFNGQAPLKGC

LLSEKGKQ*HAEILFLDKIRSMELSQVIITCYLTWSPCPNC*AWQLAAFKRDRPDLILHIYTSRLYFHWKRP

FQKGLCSLWQSGILVDVMDLPQFTDCWTNFVNPKRPFWPWKGLEIISRRTQRRLHRIKESWGLQDLVNDF

GNLQLGPPMS (italic: nucleic acid editing domain)

-continued hAPOBEC-3A (*Homo sapiens*):

(SEQ ID NO: 1388)

MEASPASGPRHLMDPHIFTSNFNNGIGRHKTYLCYEVERLDNGTSVKMDQHRGFLHNQAKNLLCGFYGRH

AELRFLDLVPSLQLDPAQIYRVTWFISWSPCFSWGCAGEVRAFLQENTHVRLRIFAARIYDYDPLYKEAL

QMLRDAGAQVSIMTYDEFKHCWDTFVDHQGCPFQPWDGLDEHSQALSGRLRAILQNQGN ( hAPOBEC-3F (*Homo sapiens*):

(SEQ ID NO: 1389)

MKPHFRNTVERMYRDTFSYNFYNRPILSRRNTVWLCYEVKTKGPSRPRLDAKIFRGQVYSQPEHHAEMCF

LSWFCGNQLPAYKCFQITWFVSWTPCPDCVAKLAEFLAEHPNVTLTISAARLYYYWERDYRRALCRLSQA

GARVKIMDDEEFAYCWENFVYSEGQPFMPWYKFDDNYAFLHRTLKEILRNPMEAMYPHIFYFHFKNLRKA

YGRNESWLCFTMEVVKHHSPVSWKRGVFRNQVDPETHCHAERCFLSWFCDDILSPNTNYEVTWYTSWSPC

PECAGEVAEFLARHSNVNLTIFTARLYYFWDTDYQEGLRSLSQEGASVEIMGYKDEKYCWENFVYNDDEP

FKPWKGLKYNFLFLDSKLQEILE

Rhesus macaque APOBEC-3G:

(SEQ ID NO: 1390)

<u>*MVEPMDPRTFVSNFNNRPILSGLNTVWLCCEVKTKDPSGPPLDAKIFQGKVYSKAKYHPEMRFLRWFHKW*</u>

RQLHHDQEYKVTWYVSWSPCTRCANSVATFLAKDPKVTLTIFVARLYYFWKPDYQQALRILCQKRGGPHA

TMKIMNYNEFQDCWNKFVDGRGKPFKPRNNLPKHYTLLQATLGELLRHLMDPGTFTSNFNNKPWVSGQHE

TYLCYKVERLHNDTWVPLNQHRGFLRNQAPNIHGFPKGRHAELCFLDLIPFWKLDGQQYRVTCFTSWSPC

FSCAQEMAKFISNNEHVSLCIFAARIYDDQGRYQEGLRALHRDGAKIAMMNYSEFEYCWDTFVDRQGRPF

QPWDGLDEHSQALSGRLRAI (italic: nucleic acid editing domain; underline: cytoplasmic localization signal)

Chimpanzee APOBEC-3G:

(SEQ ID NO: 1391)

<u>MKPHFRNPVERMYQDTFSDNFYNRPILSHRNTVWLCYEVKTKGPSRPPLDAKIFRGQVYSKLKY*HPEMRF*</u>

*FHWFSKWRKLHRDQEYEVTWYISWSPCTKC*TRDVATFLAEDPKVTLTIFVARLYYFWDPDYQEALRSLCQ

KRDGPRATMKIMNYDEFQHCWSKFVYSQRELFEPWNNLPKYYILLHIMLGEILRHSMDPPTFTSNFNNEL

WVRGRHETYLCYEVERLHNDTWVLLNQRRGFLCNQAPHKHGFLEGR*HAELCFLDVIPFWKLDLHQDYRVT*

*CFTSWSPCFSC*AQEMAKFISNNKHVSLCIFAARIYDDQGRCQEGLRTLAKAGAKISIMTYSEFKHCWDTF

VDHQGCPFQPWDGLEEHSQALSGRLRAILQNQGN (italic: nucleic acid editing domain; underline: cytoplasmic localization signal)

Green monkey APOBEC-3G:

(SEQ ID NO: 1392)

<u>MNPQIRNMVEQMEPDIFVYYFNNRPILSGRNTVWLCYEVKTKDPSGPPLDANIFQGKLYPEAKD*HPEMKF*</u>

*LHWFRKWRQLHRDQEYEVTWYVSWSPCTRC*ANSVATFLAEDPKVTLTIFVARLYYFWKPDYQQALRILCQ

ERGGPHATMKIMNYNEFQHCWNEFVDGQGKPFKPRKNLPKHYTLLHATLGELLRHVMDPGTFTSNFNNKP

WVSGQRETYLCYKVERSHNDTWVLLNQHRGFLRNQAPDRHGFPKGR*HAELCFLDLLPFWKLDDQQYRVTC*

*FTSWSPCFSC*AQKMAKFISNNKHVSLCIFAARIYDDQGRCQEGLRTLHRDGAKIAVMNYSEFEYCWDTFV

DRQGRPFQPWDGLDEHSQALSGRLRAI (italic: nucleic acid editing domain; underline: cytoplasmic localization signal)

Human APOBEC-3G:

(SEQ ID NO: 1393)

<u>MKPHFRNTVERMYRDTFSYNFYNRPILSRRNTVWLCYEVKTKGPSRPPLDAKIFRGQVYSELKY*HPEMRF*</u>

*FHWFSKWRKLHRDQEYEVTWYISWSPCTKC*TRDMATFLAEDPKVTLTIFVARLYYFWDPDYQEALRSLCQ

KRDGPRATMKIMNYDEFQHCWSKFVYSQRELFEPWNNLPKYYILLHIMLGEILRHSMDPPTFTFNFNNEP

WVRGRHETYLCYEVERMHNDTWVLLNQRRGFLCNQAPHKHGFLEGR*HAELCFLDVIPFWKLDLDQDYRVT*

-continued

*CFTSWSPCFSC*AQEMAKFISKNKHVSLCIFTARIYDDQGRCQEGLRTLAEEAGAKISIMTYSEFKHCWDTF

VDHQGCPFQPWDGLDEHSQDLSGRLRAILQNQEN (italic: nucleic acid editing domain; underline: cytoplasmic localization signal)

Human APOBEC-3F:

(SEQ ID NO: 1389)

MKPHFRNTVERMYRDTFSYNFYNRPILSRRNTVWLCYEVKTKGPSRPRLDAKIFRGQVYSQPEH*HAEMCF*

*LSWFCGNQLPAYKCFQITWFVSWTPCPDC*VAKLAEFLAEHPNVTLTISAARLYYYWERDYRRALCRLSQA

GARVKIMDDEEFAYCWENFVYSEGQPFMPWYKFDDNYAFLHRTLKEILRNPMEAMYPHIFYFHFKNLRKA

YGRNESWLCFTMEVVKHHSPVSWKRGVFRNQVDPETHC*HAERCFLSWFCDDILSPNTNYEVTWYTSWSPC*

*PEC*AGEVAEFLARHSNVNLTIFTARLYYFWDTDYQEGLRSLSQEGASVEIMGYKDFKYCWENFVYNDDEP

FKPWKGLKYNFLFLDSKLQEILE (italic: nucleic acid editing domain)

Human APOBEC-3B:

(SEQ ID NO: 1394)

MNPQIRNPMERMYRDTFYDNFENEPILYGRSYTWLCYEVKIKRGRSNLLWDTGVFRGQVYFKPQY*HAEMC*

*FLSWFCGNQLPAYKCFQITWFVSWTPCPDC*VAKLAEFLSEHPNVTLTISAARLYYYWERDYRRALCRLSQ

AGARVTIMDYEEFAYCWENFVYNEGQQFMPWYKFDENYAFLHRTLKEILRYLMDPDTFTFNFNNDPLVLR

RRQTYLCYEVERLDNGTWVLMDQHMGFLCNEAKNLLCGFY*GRHAELRFLDLVPSLQLDPAQIYRVTWFIS*

*WSPCFSWGC*AGEVRAFLQENTHVRLRIFAARIYDYDPLYKEALQMLRDAGAQVSIMTYDEFEYCWDTFVY

RQGCPFQPWDGLEEHSQALSGRLRAILQNQGN (italic: nucleic acid editing domain)

Rat APOBEC-3B:

(SEQ ID NO: 1395)

MQPQGLGPNAGMGPVCLGCSHRRPYSPIRNPLKKLYQQTFYFHFKNVRYAWGRKNNFLCYEVNGMDCALP

VPLRQGVFRKQGHIHAELCFIYWFHDKVLRVLSPMEEFKVTWYMSWSPCSKCAEQVARFLAAHRNLSLAI

FSSRLYYYLRNPNYQQKLCRLIQEGVHVAAMDLPEFKKCWNKFVDNDGQPFRPWMRLRINFSFYDCKLQE

IFSRMNLLREDVFYLQFNNSHRVKPVQNRYYRRKSYLCYQLERANGQEPLKGYLLYKKGEQHVEILFLEK

MRSMELSQVRITCYLTWSPCPNCARQLAAFKKDHPDLILRIYTSRLYFWRKKFQKGLCTLWRSGIHVDVM

DLPQFADCWTNFVNPQRPFRPWNELEKNSWRIQRRLRRIKESWGL

Bovine APOBEC-3B:

(SEQ ID NO: 1396)

DGWEVAFRSGTVLKAGVLGVSMTEGWAGSGHPGQGACVWTPGTRNTMNLLREVLFKQQFGNQPRVPAPYY

RRKTYLCYQLKQRNDLTLDRGCFRNKKQRHAERFIDKINSLDLNPSQSYKIICYITWSPCPNCANELVNE

ITRNNHLKLEIFASRLYFHWIKSFKMGLQDLQNAGISVAVMTHTEFEDCWEQFVDNQSRPFQPWDKLEQY

SASIRRRLQRILTAPI

Chimpanzee APOBEC-3B:

(SEQ ID NO: 1397)

MNPQIRNPMEWMYQRTFYYNFENEPILYGRSYTWLCYEVKIRRGHSNLLWDTGVFRGQMYSQPEHHAEMC

FLSWFCGNQLSAYKCFQITWFVSWTPCPDCVAKLAKFLAEHPNVTLTISAARLYYYWERDYRRALCRLSQ

AGARVKIMDDEEFAYCWENFVYNEGQPFMPWYKFDDNYAFLHRTLKEIIRHLMDPDTFTFNFNNDPLVLR

RHQTYLCYEVERLDNGTWVLMDQHMGFLCNEAKNLLCGFYGRHAELRFLDLVPSLQLDPAQIYRVTWFIS

WSPCFSWGCAGQVRAFLQENTHVRLRIFAARIYDYDPLYKEALQMLRDAGAQVSIMTYDEFEYCWDTFVY

RQGCPFQPWDGLEEHSQALSGRLRAILQVRASSLCMVPHRPPPPPQSPGPCLPLCSEPPLGSLLPTGRPA

PSLPFLLTASFSFPPPASLPPLPSLSLSPGHLPVPSFHSLTSCSIQPPCSSRIRETEGWASVSKEGRDLG

-continued

Human APOBEC-3C:
(SEQ ID NO: 1398)

MNPQIRNPMKAMYPGTFYFQFKNLWEANDRNETWLCFTVEGIKRRSVVSWKTGVFRNQVDSETH*CHAERC*

*FLSWFCDDILSPNTKYQVTWYTSWSPCPDC*AGEVAEFLARHSNVNLTIFTARLYYFQYPCYQEGLRSLSQ

EGVAVEIMDYEDFKYCWENFVYNDNEPFKPWKGLKTNFRLLKRRLRESLQ (italic: nucleic acid editing domain)

Gorilla APOBEC-3C
(SEQ ID NO: 1399)

MNPQIRNPMKAMYPGTFYFQFKNLWEANDRNETWLCFTVEGIKRRSVVSWKTGVFRNQVDSETH*CHAERC*

*FLSWECDDILSPNTNYQVTWYTSWSPCPEC*AGEVAEFLARHSNVNLTIFTARLYYFQDTDYQEGLRSLSQ

EGVAVKIMDYKDFKYCWENFVYNDDEPFKPWKGLKYNFRFLKRRLQEILE (italic: nucleic acid editing domain)

Human APOBEC-3A:
(SEQ ID NO: 1388)

MEASPASGPRHLMDPHIFTSNFNNGIGRHKTYLCYEVERLDNGTSVKMDQHRGFLHNQAKNLLCGFYGR*H*

*AELRFLDLVPSLQLDPAQIYRVTWFISWSPCFSWGC*AGEVRAFLQENTHVRLRIFAARIYDYDPLYKEAL

QMLRDAGAQVSIMTYDEFKHCWDTFVDHQGCPFQPWDGLDEHSQALSGRLRAILQNQGN (italic: nucleic acid editing domain)

Rhesus macaque APOBEC-3A:
(SEQ ID NO: 1400)

MDGSPASRPRHLMDPNTFTFNFNNDLSVRGRHQTYLCYEVERLDNGTWVPMDERRGFLCNKAKNVPCGDY

GC*HVELRFLCEVPSWQLDPAQTYRVTWFISWSPC*FRRGCAGQVRVFLQENKHVRLRIFAARIYDYDPLYQ

EALRTLRDAGAQVSIMTYEEFKHCWDTFVDRQGRPFQPWDGLDEHSQALSGRLRAILQNQGN (italic: nucleic acid editing domain)

Bovine APOBEC-3A:
(SEQ ID NO: 1401)

MDEYTFTENFNNQGWPSKTYLCYEMERLDGDATIPLDEYKGFVRNKGLDQPEKPC*HAELYFLGKIHSWNL*

*DRNQHYRLTCFISWSPC*YDCAQKLTTFLKENHHISLHILASRIYTHNRFGCHQSGLCELQAAGARITIMT

FEDFKHCWETFVDHKGKPFQPWEGLNVKSQALCTELQAILKTQQN (italic: nucleic acid editing domain)

Human APOBEC-3H:
(SEQ ID NO: 1402)

MALLTAETFRLQFNNKRRLRRPYYPRKALLCYQLTPQNGSTPTRGYFENKKKC*HAEICFINEIKSMGLDE*

*TQCYQVTCYLTWSPCSSC*AWELVDFIKAHDHLNLGIFASRLYYHWCKPQQKGLRLLCGSQVPVEVMGFPK

FADCWENFVDHEKPLSFNPYKMLEELDKNSRAIKRRLERIKIPGVRAQGRYMDILCDAEV (italic: nucleic acid editing domain)

Rhesus macaque APOBEC-3H:
(SEQ ID NO: 1403)

MALLTAKTFSLQFNNKRRVNKPYYPRKALLCYQLTPQNGSTPTRGHLKNKKKDHAEIRFINKIKSMGLDE

TQCYQVTCYLTWSPCPSCAGELVDFIKAHRHLNLRIFASRLYYHWRPNYQEGLLLLCGSQVPVEVMGLPE

FTDCWENFVDHKEPPSFNPSEKLEELDKNSQAIKRRLERIKSRSVDVLENGLRSLQLGPVTPSSSIRNSR

Human APOBEC-3D:
(SEQ ID NO: 1404)

MNPQIRNPMERMYRDTFYDNFENEPILYGRSYTWLCYEVKIKRGRSNLLWDTGVFRGPVLPKRQSNHRQE

VYFRFEN*HAEMCFLSWFCGNRLPANRRFQITWFVSWNPCLPC*VVKVTKFLAEHPNVTLTISAARLYYYRD

RDWRWVLLRLHKAGARVKIMDYEDFAYCWENFVCNEGQPFMPWYKFDDNYASLHRTLKEILRNPMEAMYP

HIFYFHFKNLLKACGRNESWLCFTMEVTKHHSAVFRKRGVFRNQVDPETHC*HAERCFLSWFCDDILSPNT*

-continued

NYEVTWYTSWSPCPECAGEVAEFLARHSNVNLTIFTARLCYFWDTDYQEGLCSLSQEGASVKIMGYKDFV

SCWKNFVYSDDEPFKPWKGLQTNFRLLKRRLREILQ (italic: nucleic acid editing domain)

Human APOBEC-1:

(SEQ ID NO: 1405)

MTSEKGPSTGDPTLRRRIEPWEFDVFYDPRELRKEACLLYEIKWGMSRKIWRSSGKNTTNHVEVNFIKKE

TSERDFHPSMSCSITWFLSWSPCWECSQAIREFLSRHPGVTLVIYVARLFWHMDQQNRQGLRDLVNSGVT

IQIMRASEYYHCWRNFVNYPPGDEAHWPQYPPLWMMLYALELHCIILSLPPCLKISRRWQNHLTFFRLHL

QNCHYQTIPPHILLATGLIHPSVAWR

Mouse APOBEC-1:

(SEQ ID NO: 1406)

MSSETGPVAVDPTLRRRIEPHEFEVFFDPRELRKETCLLYEINWGGRHSVWRHTSQNTSNHVEVNFLEKF

TTERYFRPNTRCSITWFLSWSPCGECSRAITEFLSRHPYVTLFIYIARLYHHTDQRNRQGLRDLISSGVT

IQIMTEQEYCYCWRNFVNYPPSNEAYWPRYPHLWVKLYVLELYCIILGLPPCLKILRRKQPQLTFFTITL

QTCHYQRIPPHLLWATGLK

Rat APOBEC-1:

(SEQ ID NO: 1378)

MSSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVT

IQIMTEQESGYCWRNFVNYSPSNEAHWPRYPHLWVRLYVLELYCIILGLPPCLNILRRKQPQLTFFTIAL

QSCHYQRLPPHILWATGLK

Human APOBEC-2:

(SEQ ID NO: 1407)

MAQKEEAAVATEAASQNGEDLENLDDPEKLKELIELPPFEIVTGERLPANFFKFQFRNVEYSSGRNKTFL

CYVVEAQGKGGQVQASRGYLEDEHAAAHAEEAFFNTILPAFDPALRYNVTWYVSSSPCAACADRIIKTLS

KTKNLRLLILVGRLFMWEEPEIQAALKKLKEAGCKLRIMKPQDFEYVWQNFVEQEEGESKAFQPWEDIQE

NFLYYEEKLADILK

Mouse APOBEC-2:

(SEQ ID NO: 1408)

MAQKEEAAEAAAPASQNGDDLENLEDPEKLKELIDLPPFEIVTGVRLPVNFFKFQFRNVEYSSGRNKTFL

CYVVEVQSKGGQAQATQGYLEDEHAGAHAEEAFFNTILPAFDPALKYNVTWYVSSSPCAACADRILKTLS

KTKNLRLLILVSRLFMWEEPEVQAALKKLKEAGCKLRIMKPQDFEYIWQNFVEQEEGESKAFEPWEDIQE

NFLYYEEKLADILK

Rat APOBEC-2:

(SEQ ID NO: 1409)

MAQKEEAAEAAAPASQNGDDLENLEDPEKLKELIDLPPFEIVTGVRLPVNFFKFQFRNVEYSSGRNKTFL

CYvVEAQSKGGQVQATQGYLEDEHAGAHAEEAFFNTILPAFDPALKYNVTWYVSSSPCAACADRILKTLS

KTKNLRLLILVSRLFMWEEPEVQAALKKLKEAGCKLRIMKPQDFEYLWQNFVEQEEGESKAFEPWEDIQE

NFLYYEEKLADILK

Bovine APOBEC-2:

(SEQ ID NO: 1384)

MAQKEEAAAAAEPASQNGEEVENLEDPEKLKELIELPPFEIVTGERLPAHYFKFQFRNVEYSSGRNKTFL

CYVVEAQSKGGQVQASRGYLEDEHATNHAEEAFFNSIMPTFDPALRYMVTWYVSSSPCAACADRIVKTLN

KTKNLRLLILVGRLFMWEEPEIQAALRKLKEAGCRLRIMKPQDFEYIWQNFVEQEEGESKAFEPWEDIQE

NFLYYEEKLADILK

-continued

*Petromyzon marinus* CDA1 (pmCDA1):
(SEQ ID NO: 1410)
MTDAEYVRIHEKLDIYTFKKQFFNNKKSVSHRCYVLFELKRRGERRACFWGYAVNKPQSGTERGIHAEIF

SIRKVEEYLRDNPGQFTINWYSSWSPCADCAEKILEWYNQELRGNGHTLKIWACKLYYEKNARNQIGLWN

LRDNGVGLNVMVSEHYQCCRKIFIQSSHNQLNENRWLEKTLKRAEKRRSELSFMIQVKILHTTKSPAV

Human APOBEC3G D316R D317R:
(SEQ ID NO: 1411)
MKPHFRNTVERMYRDTFSYNFYNRPILSRRNTVWLCYEVKTKGPSRPPLDAKIFRGQVYSELKYHPEMRF

FHWFSKWRKLHRDQEYEVTWYISWSPCTKCTRDMATFLAEDPKVTLTIFVARLYYFWDPDYQEALRSLCQ

KRDGPRATMKFNYDEFQHCWSKFVYSQRELFEPWNNLPKYYILLHFMLGEILRHSMDPPTFTFNFNNEPW

VRGRHETYLCYEVERMHNDTWVLLNQRRGFLCNQAPHKHGFLEGRHAELCFLDVIPFWKLDLDQDYRVTC

FTSWSPCFSCAQEMAKFISKKHVSLCIFTARIYRRQGRCQEGLRTLAEAGAKISFTYSEFKHCWDTFVDH

QGCPFQPWDGLDEHSQDLSGRLRAILQNQEN

Human APOBEC3G chain A:
(SEQ ID NO: 1412)
MDPPTFTFNFNNEPWWGRHETYLCYEVERMHNDTWVLLNQRRGFLCNQAPHKHGFLEGRHAELCFLDVIP

FWKLDLDQDYRVTCFTSWSPCFSCAQEMAKFISKNKHVSLCIFTARIYDDQGRCQEGLRTLAEAGAKISF

TYSEFKHCWDTFVDHQGCPFQPWDGLDEHSQDLSGRLRAILQ

Human APOBEC3G chain A D120R D121R:
(SEQ ID NO: 1413)
MDPPTFTFNFNNEPWVRGRHETYLCYEVERMHNDTWVLLNQRRGFLCNQAPHKHGFLEGRHAELCFLDVI

PFWKLDLDQDYRVTCFTSWSPCFSCAQEMAKFISKNKHVSLCIFTARTYRRQGRCQEGLRTLAEAGAKIS

FMTYSEFKHCWDTFVDHQGCPFQPWDGLDEHSQDLSGRLRAILQ hAPOBEC-4 (*Homo sapiens*):
(SEQ ID NO: 1414)
MEPIYEEYLANHGTIVKPYYWLSFSLDCSNCPYHIRTGEEARVSLTEFCQIFGFPYGTTFPQTKHLTFYE

LKTSSGSLVQKGHASSCTGNYIHPESMLFEMNGYLDSAIYNNDSIRHIILYSNNSPCNEANHCCISKMYN

FLITYPGITLSIYFSQLYHTEMDFPASAWNREALRSLASLWPRVVLSPISGGIWHSVLHSFISGVSGSHV

FQPILTGRALADRHNAYEINAITGVKPYFTDVLLQTKRNPNTKAQEALESYPLNNAFPGQFFQMPSGQLQ

PNLPPDLRAPVVFVLVPLRDLPPMHMGQNPNKPRNIVRHLNMPQMSFQETKDLGRLPTGRSVEIVEITEQ

FASSKEADEKKKKKGKK mAPOBEC-4 (*Mus musculus*):
(SEQ ID NO: 1373)
MDSLLMKQKKFLYHFKNVRWAKGRHETYLCYVVKRRDSATSCSLDFGHLRNKSGCHVELLFLRYISDWDL

DPGRCYRVTWFTSWSPCYDCARHVAEFLRWNPNLSLRIFTARLYFCEDRKAEPEGLRRLHRAGVQIGIMT

FKDYFYCWNTFVENRERTFKAWEGLHENSVRLTRQLRRILLPLYEVDDLRDAFRMLGF rAPOBEC-4 (*Rattus norvegicus*):
(SEQ ID NO: 1415)
MEPLYEEYLTHSGTIVKPYYWLSVSLNCTNCPYHIRTGEEARVPYTEFHQTFGFPWSTYPQTKHLTFYEL

RSSSGNLIQKGLASNCTGSHTHPESMLFERDGYLDSLIFHDSNIRHIILYSNNSPCDEANHCCISKMYNF

LMNYPEVTLSVFFSQLYHTENQFPTSAWNREALRGLASLWPQVTLSAISGGIWQSILETFVSGISEGLTA

VRPFTAGRTLTDRYNAYEINCITEVKPYFTDALHSWQKENQDQKVWAASENQPLHNTTPAQWQPDMSQDC

RTPAVFMLVPYRDLPPIHVNPSPQKPRTVVRHLNTLQLSASKVKALRKSPSGRPVKKEEARKGSTRSQEA

NETNKSKWKKQTLFIKSNICHLLEREQKKIGILSSWSV mfAPOBEC-4 (*Macaca fascicularis*):
(SEQ ID NO: 1416)
MEPTYEEYLANHGTIVKPYYWLSFSLDCSNCPYHIRTGEEARVSLTEFCQIFGFPYGTTYPQTKHLTFYE

LKTSSGSLVQKGHASSCTGNYIHPESMLFEMNGYLDSAIYNNDSIRHIILYCNNSPCNEANHCCISKVYN

-continued

FLITYPGITLSIYFSQLYHTEMDFPASAWNREALRSLASLWPRVVLSPISGGIWHSVLHSFVSGVSGSHV

FQPILTGRALTDRYNAYEINAITGVKPFFTDVLLHTKRNPNTKAQMALESYPLNNAFPGQSFQMTSGIPP

DLRAPVVFVLLPLRDLPPMHMGQDPNKPRNIIRHLNMPQMSFQETKDLERLPTRRSVETVEITERFASSK

QAEEKTKKKKGKK pmCDA-1 (*Petromyzon marinus*):
                                                                                         (SEQ ID NO: 1417)
MAGYECVRVSEKLDFDTFEFQFENLHYATERHRTYVIFDVKPQSAGGRSRRLWGYIINNPNVCHAELILM

SMIDRHLESNPGVYAMTWYMSWSPCANCSSKLNPWLKNLLEEQGHTLTMHFSRIYDRDREGDHRGLRGLK

HVSNSFRMGVVGRAEVKECLAEYVEASRRTLTWLDTTESMAAKMRRKLFCILVRCAGMRESGIPLHLFTL

QTPLLSGRVVWWRV pmCDA-2 (*Petromyzon marinus*):
                                                                                         (SEQ ID NO: 1418)
MELREVVDCALASCVRHEPLSRVAFLRCFAAPSQKPRGTVILFYVEGAGRGVTGGHAVNYNKQGTSIHAE

VLLLSAVRAALLRRRRCEDGEEATRGCTLHCYSTYSPCRDCVEYIQEFGASTGVRVVIHCCRLYELDVNR

RRSEAEGVLRSLSRLGRDFRLMGPRDAIALLLGGRLANTADGESGASGNAWVTETNVVEPLVDMTGFGDE

DLHAQVQRNKQIREAYANYASAVSLMLGELHVDPDKFPFLAEFLAQTSVEPSGTPRETRGRPRGASSRGP

EIGRQRPADFERALGAYGLFLHPRIVSREADREEIKRDLIVVMRKHNYQGP pmCDA-5 (*Petromyzon marinus*):
                                                                                         (SEQ ID NO: 1419)
MAGDENVRVSEKLDFDTFEFQFENLHYATERHRTYVIFDVKPQSAGGRSRRLWGYIINNPNVCHAELILM

SMIDRHLESNPGVYAMTWYMSWSPCANCSSKLNPWLKNLLEEQGHTLMMHFSRIYDRDREGDHRGLRGLK

HVSNSFRMGVVGRAEVKECLAEYVEASRRTLTWLDTTESMAAKMRRKLFCILVRCAGMRESGMPLHLFT yCD (*Saccharomyces cerevisiae*):
                                                                                         (SEQ ID NO: 1420)
MVTGGMASKWDQKGMDIAYEEAALGYKEGGVPIGGCLINNKDGSVLGRGHNMRFQKGSATLHGEISTLEN

CGRLEGKVYKDTTLYTTLSPCDMCTGAIIMYGIPRCVVGENVNFKSKGEKYLQTRGHEVVVVDDERCKKI

MKQFIDERPQDWFEDIGE rAPOBEC-1 (delta 177-186):
                                                                                         (SEQ ID NO: 1421)
MSSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVT

IQIMTEQESGYCWRNFVNYSPSNEAHWPRYPHLWVRGLPPCLNILRRKQPQLTFFTIALQSCHYQRLPPH

ILWATGLK rAPOBEC-1 (delta 202-213):
                                                                                         (SEQ ID NO: 1422)
MSSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVT

TQIMTEQESGYCWRNFVNYSPSNEAHWPRYPHLWVRLYVLELYCIILGLPPCLNILRRKQPQHYQRLPPH

ILWATGLK

Mouse APOBEC-3:
                                                                                         (SEQ ID NO: 1386)
MGPFCLGCSHRKCYSPIRNLISQETFKFHFKNLGYAKGRKDTFLCYEVTRKDCDSPVSLHHGVF

KNKDNI*HAEICFLYWFHDKVLKVLSPREEFKITWYMSWSPCFEC*AEQIVRFLATHHNLSLDIFS

SRLYNVQDPETQQNLCRLVQEGAQVAAMDLYEFKKCWKKFVDNGGRRFRPWKRLLTNFRYQDSK

LQEILRPCYIPVPSSSSSTLSNICLTKGLPETRFCVEGRRMDPLSEEEFYSQFYNQRVKHLCYY

HWMKPYLCYQLEQFNGQAPLKGCLLSEKGEQ*HAEILFLDKIRSMELSQVTITCYLTWSPCPNCA*

-continued

WQLAAFKRDRPDLILHIYTSRLYFHWKRPFQKGLCSLWQSGILVDVMDLPQFTDCWTNFVNPKR

PFWPWKGLEIISRRTQRRLRRIKESWGLQDLVNDFGNLQLGPPMS (italic: nucleic acid editing domain)

Some aspects of the present disclosure are based on the recognition that modulating the deaminase domain catalytic activity of any of the fusion proteins described herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deamination window can prevent unwanted deamination of residues adjacent to specific target residues, which can decrease or prevent off-target effects.

For example, in some embodiments, an APOBEC deaminase incorporated into a base editor can comprise one or more mutations selected from the group consisting of H121X, H122X, R126X, R126X, R118X, W90X, W90X, and R132X of rAPOBEC1, or one or more corresponding mutations in another APOBEC deaminase, wherein X is any amino acid. In some embodiments, an APOBEC deaminase incorporated into a base editor can comprise one or more mutations selected from the group consisting of H121R, H122R, R126A, R126E, R118A, W90A, W90Y, and R132E of rAPOBEC1, or one or more corresponding mutations in another APOBEC deaminase.

In some embodiments, an APOBEC deaminase incorporated into a base editor can comprise one or more mutations selected from the group consisting of D316X, D317X, R320X, R320X, R313X, W285X, W285X, R326X of hAPOBEC3G, or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G, or one or more corresponding mutations in another APOBEC deaminase.

In some embodiments, an APOBEC deaminase incorporated into a base editor can comprise a H121R and a H122R mutation of rAPOBEC1, or one or more corresponding mutations in another APOBEC deaminase. In some embodiments an APOBEC deaminase incorporated into a base editor can comprise an APOBEC deaminase comprising a R126A mutation of rAPOBEC1, or one or more corresponding mutations in another APOBEC deaminase. In some embodiments, an APOBEC deaminase incorporated into a base editor can comprise an APOBEC deaminase comprising a R126E mutation of rAPOBEC1, or one or more corresponding mutations in another APOBEC deaminase. In some embodiments, an APOBEC deaminase incorporated into a base editor can comprise an APOBEC deaminase comprising a R118A mutation of rAPOBEC1, or one or more corresponding mutations in another APOBEC deaminase. In some embodiments, an APOBEC deaminase incorporated into a base editor can comprise an APOBEC deaminase comprising a W90A mutation of rAPOBEC1, or one or more corresponding mutations in another APOBEC deaminase. In some embodiments, an APOBEC deaminase incorporated into a base editor can comprise an APOBEC deaminase comprising a W90Y mutation of rAPOBEC1, or one or more corresponding mutations in another APOBEC deaminase. In some embodiments, an APOBEC deaminase incorporated into a base editor can comprise an APOBEC deaminase comprising a R132E mutation of rAPOBEC1, or one or more corresponding mutations in another APOBEC deaminase. In some embodiments an APOBEC deaminase incorporated into a base editor can comprise an APOBEC deaminase comprising a W90Y and a R126E mutation of rAPOBEC1, or one or more corresponding mutations in another APOBEC deaminase. In some embodiments, an APOBEC deaminase incorporated into a base editor can comprise an APOBEC deaminase comprising a R126E and a R132E mutation of rAPOBEC1, or one or more corresponding mutations in another APOBEC deaminase. In some embodiments, an APOBEC deaminase incorporated into a base editor can comprise an APOBEC deaminase comprising a W90Y and a R132E mutation of rAPOBEC1, or one or more corresponding mutations in another APOBEC deaminase. In some embodiments, an APOBEC deaminase incorporated into a base editor can comprise an APOBEC deaminase comprising a W90Y, R126E, and R132E mutation of rAPOBEC1, or one or more corresponding mutations in another APOBEC deaminase.

In some embodiments, an APOBEC deaminase incorporated into a base editor can comprise an APOBEC deaminase comprising a D316R and a D317R mutation of hAPOBEC3G, or one or more corresponding mutations in another APOBEC deaminase. In some embodiments, any of the fusion proteins provided herein comprise an APOBEC deaminase comprising a R320A mutation of hAPOBEC3G, or one or more corresponding mutations in another APOBEC deaminase. In some embodiments, an APOBEC deaminase incorporated into a base editor can comprise an APOBEC deaminase comprising a R320E mutation of hAPOBEC3G, or one or more corresponding mutations in another APOBEC deaminase. In some embodiments, an APOBEC deaminase incorporated into a base editor can comprise an APOBEC deaminase comprising a R313A mutation of hAPOBEC3G, or one or more corresponding mutations in another APOBEC deaminase. In some embodiments, an APOBEC deaminase incorporated into a base editor can comprise an APOBEC deaminase comprising a W285A mutation of hAPOBEC3G, or one or more corresponding mutations in another APOBEC deaminase. In some embodiments, an APOBEC deaminase incorporated into a base editor can comprise an APOBEC deaminase comprising a W285Y mutation of hAPOBEC3G, or one or more corresponding mutations in another APOBEC deaminase. In some embodiments, an APOBEC deaminase incorporated into a base editor can comprise an APOBEC deaminase comprising a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R320E mutation of hAPOBEC3G, or one or more corresponding mutations in another APOBEC deaminase. In some embodiments, an APOBEC deaminase incorporated into a base editor can comprise an APOBEC deaminase comprising a R320E and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y, R320E, and R326E mutation of hAPOBEC3G, or one or more corresponding mutations in another APOBEC deaminase.

A number of modified cytidine deaminases are commercially available, including, but not limited to, SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177). In some embodiments, a deaminase incorporated into a base editor comprises all or a portion of an APOBEC1 deaminase.

Details of C to T nucleobase editing proteins are described in International PCT Application No. PCT/US2016/058344 (WO2017/070632) and Komor, A. C., et al., "Programmable editing of a target base in genomic DNA without double-stranded DNA cleavage" Nature 533, 420-424 (2016), the entire contents of which are hereby incorporated by reference.

Cytidine Deaminases

In some embodiments, the fusion proteins of the invention comprise one or more cytidine deaminase domains. In some embodiments, the cytidine deaminases provided herein are capable of deaminating cytosine or 5-methylcytosine to uracil or thymine. In some embodiments, the cytidine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). Some embodiments provide a polynucleotide molecule encoding the cytidine deaminase nucleobase editor polypeptide of any previous aspect or as delineated herein. In some embodiments, the polynucleotide is codon optimized.

The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

A fusion protein of the invention second protein comprises two or more nucleic acid editing domains. In some embodiments, the nucleic acid editing domain can catalyze a C to U base change. In some embodiments, the nucleic acid editing domain is a deaminase domain. In some embodiments, the deaminase is a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deaminase is a human APOBEC3G. In some embodiments, the deaminase is a fragment of the human APOBEC3G. In some embodiments, the deaminase is a human APOBEC3G variant comprising a D316R D317R mutation. In some embodiments, the deaminase is a fragment of the human APOBEC3G and comprising mutations corresponding to the D316R D317R mutations. In some embodiments, the nucleic acid editing domain is at least 80%, at least 85%, at least 90%, at least 92%, at least 95%, at least 96%, at least 97%, at least 98%, at least 99%), or at least 99.5% identical to the deaminase domain of any deaminase described herein.

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

In some embodiments, the modified Cas9 is a high fidelity Cas9 enzyme. In some embodiments, the high fidelity Cas9 enzyme is SpCas9(K855A), eSpCas9(1.1), SpCas9-HF1, or hyper accurate Cas9 variant (HypaCas9). The modified Cas9 eSpCas9(1.1) contains alanine substitutions that weaken the interactions between the HNH/RuvC groove and the non-target DNA strand, preventing strand separation and cutting at off-target sites. Similarly, SpCas9-HF1 lowers off-target editing through alanine substitutions that disrupt Cas9's interactions with the DNA phosphate backbone. HypaCas9 contains mutations (SpCas9 N692A/M694A/Q695A/H698A) in the REC3 domain that increase Cas9 proofreading and target discrimination. All three high fidelity enzymes generate less off-target editing than wildtype Cas9.

An exemplary high fidelity Cas9 is provided below. High Fidelity Cas9 domain mutations relative to Cas9 are shown in bold and underlined.

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

-continued

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGALSRKLINGIRDKQSGKTILDFLKSDGFANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRAITKHVAQILDSRiYNTKYDENDKLI

REVKVITLKSKLVSDFRKDFQFYKVREINNYHHAHDAYLNAWGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Fusion Proteins Comprising a napDNAbp and a Cytidine Deaminase and/or Adenosine Deaminase Some aspects of the disclosure provide fusion proteins comprising a Cas9 domain or other nucleic acid program-mable DNA binding protein (e.g., Cas12) and one or more cytidine deaminase or adenosine deaminase domains, and/or DNA glycosylase domains. It should be appreciated that the Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the cytidine deaminases and/or adenosine deaminases provided herein. The domains of the base editors disclosed herein can be arranged in any order.

In some embodiments, the fusion protein comprises the following domains A-C, A-D, or A-E:

NH$_2$-[A-B-C]-COOH;

NH$_2$-[A-B-C-D]-COOH; or

NH$_2$-[A-B-C-D-E]-COOH;

wherein A and C or A, C, and E, each comprises one or more of the following:

an adenosine deaminase domain or an active fragment thereof, a cytidine deaminase domain or an active fragment thereof, a DNA glycosylase domain or an active fragment thereof; and wherein B or B and D, each comprises one or more domains having nucleic acid sequence specific binding activity.

In some embodiments, the fusion protein comprises the following structure:

$NH_2$-[$A_n$-$B_o$-$C_n$]-COOH;

$NH_2$-[$A_n$-$B_o$-$C_n$-$D_o$]-COOH; or $NH_2$-[$A_n$-$B_o$-$C_p$-$D_o$-$E_q$]-COOH;

wherein A and C or A, C, and E, each comprises one or more of the following:

an adenosine deaminase domain or an active fragment thereof, a cytidine deaminase domain or an active fragment thereof, a DNA glycosylase domain or an active fragment thereof; and wherein n is an integer: 1, 2, 3, 4, or 5, wherein p is an integer: 0, 1, 2, 3, 4, or 5; wherein q is an integer 0, 1, 2, 3, 4, or 5; and wherein B or B and D each comprises a domain having nucleic acid sequence specific binding activity; and wherein o is an integer: 1, 2, 3, 4, or 5.

For example, and without limitation, in some embodiments, the fusion protein comprises the structure:

$NH_2$-[adenosine deaminase]-[Cas9 domain]-COOH;

$NH_2$-[Cas9 domain]-[adenosine deaminase]-COOH;

$NH_2$-[cytidine deaminase]-[Cas9 domain]-COOH;

$NH_2$-[Cas9 domain]-[cytidine deaminase]-COOH;

$NH_2$-[cytidine deaminase]-[Cas9 domain]-[adenosine deaminase]-COOH;

$NH_2$-[adenosine deaminase]-[Cas9 domain]-[cytidine deaminase]-COOH;

$NH_2$-[adenosine deaminase]-[cytidine deaminase]-[Cas9 domain]-COOH;

$NH_2$-[cytidine deaminase]-[adenosine deaminase]-[Cas9 domain]-COOH;

$NH_2$-[Cas9 domain]-[adenosine deaminase]-[cytidine deaminase]-COOH; or $NH_2$-[Cas9 domain]-[cytidine deaminase]-[adenosine deaminase]-COOH.

In some embodiments, any of the Cas12 domains or Cas12 proteins provided herein may be fused with any of the cytidine or adenosine deaminases provided herein. For example, and without limitation, in some embodiments, the fusion protein comprises the structure:

$NH_2$-[adenosine deaminase]-[Cas12 domain]-COOH;

$NH_2$-[Cas12 domain]-[adenosine deaminase]-COOH;

$NH_2$-[cytidine deaminase]-[Cas12 domain]-COOH;

$NH_2$-[Cas12 domain]-[cytidine deaminase]-COOH;

$NH_2$-[cytidine deaminase]-[Cas12 domain]-[adenosine deaminase]-COOH;

$NH_2$-[adenosine deaminase]-[Cas12 domain]-[cytidine deaminase]-COOH;

$NH_2$-[adenosine deaminase]-[cytidine deaminase]-[Cas12 domain]-COOH;

$NH_2$-[cytidine deaminase]-[adenosine deaminase]-[Cas12 domain]-COOH;

$NH_2$-[Cas12 domain]-[adenosine deaminase]-[cytidine deaminase]-COOH; or $NH_2$-[Cas12 domain]-[cytidine deaminase]-[adenosine deaminase]-COOH.

In some embodiments, the adenosine deaminase is a TadA*8. Exemplary fusion protein structures include the following:

$NH_2$-[TadA*8]-[Cas9 domain]-COOH;

$NH_2$-[Cas9 domain]-[TadA*8]-COOH;

$NH_2$-[TadA*8]-[Cas12 domain]-COOH; or $NH_2$-[Cas12 domain]-[TadA*8]-COOH.

In some embodiments, the adenosine deaminase of the fusion protein comprises a TadA*8 and a cytidine deaminase and/or an adenosine deaminase. In some embodiments, the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

Exemplary fusion protein structures include the following:

$NH_2$-[TadA*8]-[Cas9/Cas12]-[adenosine deaminase]-COOH;

$NH_2$-[adenosine deaminase]-[Cas9/Cas12]-[TadA*8]-COOH;

$NH_2$-[TadA*8]-[Cas9/Cas12]-[cytidine deaminase]-COOH; or $NH_2$-[cytidine deaminase]-[Cas9/Cas12]-[TadA*8]-COOH.

In some embodiments, the adenosine deaminase of the fusion protein comprises a TadA*9 and a cytidine deaminase and/or an adenosine deaminase. Exemplary fusion protein structures include the following:

$NH_2$-[TadA*9]-[Cas9/Cas12]-[adenosine deaminase]-COOH;

$NH_2$-[adenosine deaminase]-[Cas9/Cas12]-[TadA*9]-COOH;

$NH_2$-[TadA*9]-[Cas9/Cas12]-[cytidine deaminase]-COOH; or $NH_2$-[cytidine deaminase]-[Cas9/Cas12]-[TadA*9]-COOH.

In some embodiments, the fusion protein can comprise a deaminase flanked by an N-terminal fragment and a C-terminal fragment of a Cas9 or Cas12 polypeptide. In some embodiments, the fusion protein comprises a cytidine deaminase flanked by an N-terminal fragment and a C-terminal fragment of a Cas9 or Cas12 polypeptide. In some embodiments, the fusion protein comprises an adenosine deaminase flanked by an N-terminal fragment and a C-terminal fragment of a Cas9 or Cas 12 polypeptide.

In some embodiments, the fusion proteins comprising a cytidine deaminase or adenosine deaminase and a napD-NAbp (e.g., Cas9 or Cas12 domain) do not include a linker sequence. In some embodiments, a linker is present between the cytidine or adenosine deaminase and the napDNAbp. In some embodiments, the "-" used in the general architecture above indicates the presence of an optional linker. In some embodiments, cytidine or adenosine deaminase and the napDNAbp are fused via any of the linkers provided herein. For example, in some embodiments the cytidine or adenosine deaminase and the napDNAbp are fused via any of the linkers provided herein.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Exemplary, yet nonlimiting, fusion proteins are described in International PCT Application Nos. PCT/2017/044935, PCT/US2019/044935, and PCT/US2020/016288, each of which is incorporated herein by reference for its entirety.
Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of the Cas9 domain. In some embodiments, the NLS is fused to the C-terminus of an nCas9 domain or a dCas9 domain. In some embodiments, the NLS is fused to the N-terminus of the Cas12 domain. In some embodiments, the NLS is fused to the C-terminus of the Cas12 domain. In some embodiments, the NLS is fused to the N-terminus of the cytidine or adenosine deaminase. In some embodiments, the NLS is fused to the C-terminus of the cytidine or adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEG-ADKRTADGSEFESPKKKRKV (SEQ ID NO: 83), KRTADGSEFESPKKKRKV (SEQ ID NO: 84), KRPAATKKAGQAKKKK (SEQ ID NO: 85), KKTELQTTNAENKTKKL (SEQ ID NO: 86), KRGIN-DRNFWRGENGRKTR (SEQ ID NO: 87), RKSGKIAAIV-VKRPRKPKKKRKV (SEQ ID NO: 1424), or MDSLL-MNRRKFLYQFKNVRWAKGRRETYLC (SEQ ID NO: 90).

In some embodiments, the fusion proteins comprising a cytidine or adenosine deaminase, a Cas9 domain, and an NLS do not comprise a linker sequence. In some embodiments, linker sequences between one or more of the domains or proteins (e.g., cytidine or adenosine deaminase, Cas9 domain or NLS) are present. In some embodiments, a linker is present between the cytidine deaminase and adenosine deaminase domains and the napDNAbp. In some embodiments, the "-" used in the general architecture below indicates the presence of an optional linker. In some embodiments, the cytidine deaminase and adenosine deaminase and the napDNAbp are fused via any of the linkers provided herein. For example, in some embodiments the cytidine deaminase and adenosine deaminase and the napDNAbp are fused via any of the linkers provided herein.

In some embodiments, the general architecture of exemplary napDNAbp (e.g., Cas9 or Cas12) fusion proteins with a cytidine or adenosine deaminase and a napDNAbp (e.g., Cas9 or Cas12) domain comprises any one of the following structures, where NLS is a nuclear localization sequence (e.g., any NLS provided herein), $NH_2$ is the N-terminus of the fusion protein, and COOH is the C-terminus of the fusion protein:

$NH_2$-NLS-[cytidine deaminase]-[napDNAbp domain]-COOH;

$NH_2$-NLS [napDNAbp domain]-[cytidine deaminase]-COOH;

$NH_2$-[cytidine deaminase]-[napDNAbp domain]-NLS-COOH;

$NH_2$-[napDNAbp domain]-[cytidine deaminase]-NLS-COOH;

$NH_2$-NLS-[adenosine deaminase]-[napDNAbp domain]-COOH;

$NH_2$-NLS [napDNAbp domain]-[adenosine deaminase]-COOH;

$NH_2$-[adenosine deaminase]-[napDNAbp domain]-NLS-COOH;

$NH_2$-[napDNAbp domain]-[adenosine deaminase]-NLS-COOH;

$NH_2$-NLS-[cytidine deaminase]-[napDNAbp domain]-[adenosine deaminase]-COOH;

$NH_2$-NLS-[adenosine deaminase]-[napDNAbp domain]-[cytidine deaminase]-COOH;

$NH_2$-NLS-[adenosine deaminase][cytidine deaminase]-[napDNAbp domain]-COOH;

$NH_2$-NLS-[cytidine deaminase]-[adenosine deaminase]-[napDNAbp domain]-COOH;

$NH_2$-NLS-[napDNAbp domain]-[adenosine deaminase]-[cytidine deaminase]-COOH;

$NH_2$-NLS-[napDNAbp domain]-[cytidine deaminase]-[adenosine deaminase]-COOH;

$NH_2$-[cytidine deaminase]-[napDNAbp domain]-[adenosine deaminase]-NLS-COOH;

$NH_2$-[adenosine deaminase]-[napDNAbp domain]-[cytidine deaminase]-NLS-COOH;

$NH_2$-[adenosine deaminase][cytidine deaminase]-[napDNAbp domain]-NLS-COOH;

$NH_2$-[cytidine deaminase]-[adenosine deaminase]-[napDNAbp domain]-NLS-COOH;

$NH_2$-[napDNAbp domain]-[adenosine deaminase]-[cytidine deaminase]-NLS-COOH; or $NH_2$-[napDNAbp domain]-[cytidine deaminase]-[adenosine deaminase]-NLS-COOH. In some embodiments, the NLS is present in a linker or the NLS is flanked by linkers, for example described herein. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 85), is the prototype of the ubiquitous bipartite signal: two clusters of basic amino acids, separated by a spacer of about 10 amino acids. The sequence of an exemplary bipartite NLS follows: PKKKRKVEGADKRTADGSEF-ESPKKKRKV (SEQ ID NO: 83)

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the amino-terminus, about or more than about 1, 2, 3, 4, 5, 6, 7, 8, 9, 10 NLSs at or near the carboxy-terminus, or any combination thereof (e.g., one or more NLS at the amino-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise about 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

Additional Domains

A base editor described herein can include any domain which helps to facilitate the nucleobase editing, modification or altering of a nucleobase of a polynucleotide. In some embodiments, a base editor comprises a polynucleotide programmable nucleotide binding domain (e.g., Cas9), a nucleobase editing domain (e.g., deaminase domain), and one or more additional domains. In some embodiments, the additional domain can facilitate enzymatic or catalytic functions of the base editor, binding functions of the base editor, or be inhibitors of cellular machinery (e.g., enzymes) that could interfere with the desired base editing result. In some embodiments, a base editor can comprise a nuclease, a nickase, a recombinase, a deaminase, a methyltransferase, a methylase, an acetylase, an acetyltransferase, a transcriptional activator, or a transcriptional repressor domain.

In some embodiments, a base editor can comprise an uracil glycosylase inhibitor (UGI) domain. In some embodiments, cellular DNA repair response to the presence of U: G heteroduplex DNA can be responsible for a decrease in nucleobase editing efficiency in cells. In such embodiments, uracil DNA glycosylase (UDG) can catalyze removal of U from DNA in cells, which can initiate base excision repair (BER), mostly resulting in reversion of the U:G pair to a C:G pair. In such embodiments, BER can be inhibited in base editors comprising one or more domains that bind the single strand, block the edited base, inhibit UGI, inhibit BER, protect the edited base, and/or promote repairing of the non-edited strand. Thus, this disclosure contemplates a base editor fusion protein comprising a UGI domain.

In some embodiments, a base editor comprises as a domain all or a portion of a double-strand break (DSB) binding protein. For example, a DSB binding protein can include a Gam protein of bacteriophage Mu that can bind to the ends of DSBs and can protect them from degradation. See Komor, A. C., et al., "Improved base excision repair inhibition and bacteriophage Mu Gam protein yields C:G-to-T:A base editors with higher efficiency and product purity" Science Advances 3:eaao4774 (2017), the entire content of which is hereby incorporated by reference.

Additionally, in some embodiments, a Gam protein can be fused to an N terminus of a base editor. In some embodiments, a Gam protein can be fused to a C terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See Komor, A. C., et al., "Improved base excision repair inhibition and bacteriophage Mu Gam protein yields C:G-to-T:A base editors with higher efficiency and product purity" Science Advances 3:eaao4774 (2017). In some embodiments, a mutation or mutations can change the length of a base editor domain relative to a wild type domain. For example, a deletion of at least one amino acid in at least one domain can reduce the length of the base editor. In another case, a mutation or mutations do not change the length of a domain relative to a wild type domain. For example, substitutions in any domain does not change the length of the base editor.

Non-limiting examples of such base editors, where the length of all the domains is the same as the wild type domains, can include:

NH2-[nucleobase editing domain]-Linker1-[APOBEC1]-Linker2-[nucleobase editing domain]-COOH;

NH2-[nucleobase editing domain]-Linker1-[APOBEC1]-[nucleobase editing domain]-COOH;

NH2-[nucleobase editing domain]-[APOBEC1]-Linker2-[nucleobase editing domain]-COOH;

NH2-[nucleobase editing domain]-[APOBEC1]-[nucleobase editing domain]-COOH;

NH2-[nucleobase editing domain]-Linker1-[APOBEC1]-Linker2-[nucleobase editing domain]-[UGI]-COOH;

NH2-[nucleobase editing domain]-Linker1-[APOBEC1]-[nucleobase editing domain]-[UGI]-COOH;

NH2-[nucleobase editing domain]-[APOBEC1]-Linker2-[nucleobase editing domain]-[UGI]-COOH;

NH2-[nucleobase editing domain]-[APOBEC1]-[nucleobase editing domain]-[UGI]-COOH;

NH2-[UGI]-[nucleobase editing domain]-Linker1-[APOBEC1]-Linker2-[nucleobase editing domain]-COOH;

NH2-[UGI]-[nucleobase editing domain]-Linker1-[APOBEC1]-[nucleobase editing domain]-COOH;

NH2-[UGI]-[nucleobase editing domain]-[APOBEC1]-Linker2-[nucleobase editing domain]-COOH; or NH2-[UGI]-[nucleobase editing domain]-[APOBEC1]-[nucleobase editing domain]-COOH.

Base Editor System

Provided herein are systems, compositions, and methods for editing a nucleobase using a base editor system. In some embodiments, the base editor system comprises (1) a base editor (BE) comprising a polynucleotide programmable nucleotide binding domain and a nucleobase editing domain (e.g., a deaminase domain) for editing the nucleobase; and (2) a guide polynucleotide (e.g., guide RNA) in conjunction with the polynucleotide programmable nucleotide binding domain. In some embodiments, the base editor system is a cytidine base editor (CBE). In some embodiments, the base editor system is an adenosine base editor (ABE). In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the nucleobase editing domain is a deaminase domain. In some embodiments, a deaminase domain can be a cytidine deaminase or an cytosine deaminase. In some embodiments, a deaminase domain can be an adenine deaminase or an adenosine deaminase. In some embodiments, the adenosine base editor can deaminate adenine in DNA. In some embodiments, the base editor is capable of deaminating a cytidine in DNA.

In some embodiments, a base editing system as provided herein provides a new approach to genome editing that uses a fusion protein containing a catalytically defective Streptococcus pyogenes Cas9, a deaminase (e.g., cytidine or adenosine deaminase), and an inhibitor of base excision repair to induce programmable, single nucleotide (C→T or A→G) changes in DNA without generating double-strand DNA breaks, without requiring a donor DNA template, and without inducing an excess of stochastic insertions and deletions.

Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

Use of the base editor system provided herein comprises the steps of (a) contacting a target nucleotide sequence of a polynucleotide (e.g., double- or single stranded DNA or RNA) of a subject with a base editor system comprising a nucleobase editor (e.g., an adenosine base editor or a cytidine base editor) and a guide polynucleic acid (e.g., gRNA), wherein the target nucleotide sequence comprises a targeted nucleobase pair; (b) inducing strand separation of said target region; (c) converting a first nucleobase of said target nucleobase pair in a single strand of the target region to a second nucleobase; and (d) cutting no more than one strand of said target region, where a third nucleobase complementary to the first nucleobase base is replaced by a fourth nucleobase complementary to the second nucleobase. It should be appreciated that in some embodiments, step (b) is omitted. In some embodiments, said targeted nucleobase pair is a plurality of nucleobase pairs in one or more genes. In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more genes, wherein at least one gene is located in a different locus.

In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine.

In some embodiments, a single guide polynucleotide may be utilized to target a deaminase to a target nucleic acid sequence. In some embodiments, a single pair of guide polynucleotides may be utilized to target different deaminases to a target nucleic acid sequence.

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or an RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or an RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or an RNA recognition motif.

In some embodiments, the base editor inhibits base excision repair (BER) of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edit of base pair is upstream of a PAM site. In some embodiments, the intended edit of base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edit of base-pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream of the PAM site.

In some embodiments, the method does not require a canonical (e.g., NGG) PAM site. In some embodiments, the nucleobase editor comprises a linker or a spacer. In some embodiments, the linker or spacer is 1-25 amino acids in length. In some embodiments, the linker or spacer is 5-20 amino acids in length. In some embodiments, the linker or spacer is 10, 11, 12, 13, 14, 15, 16, 17, 18, 19, or 20 amino acids in length.

In some embodiments, the base editing fusion proteins provided herein need to be positioned at a precise location, for example, where a target base is placed within a defined region (e.g., a "deamination window"). In some embodiments, a target can be within a 4 base region. In some embodiments, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacterio-phage Mu Gam protein yields C:G-to-T:A base editors with higher efficiency and product purity" Science Advances 3:eaao4774 (2017), the entire contents of which are hereby incorporated by reference.

In some embodiments, the target region comprises a target window, wherein the target window comprises the target nucleobase pair. In some embodiments, the target window comprises 1-10 nucleotides. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edit of base pair is within the target window. In some embodiments, the target window comprises the intended edit of base pair. In some embodiments, the method is performed using any of the base editors provided herein. In some embodiments, a target window is a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a polynucleotide programmable nucleotide binding domain. In some embodiments, an NLS of the base editor is localized C-terminal to a polynucleotide program-mable nucleotide binding domain.

Other exemplary features that can be present in a base editor as disclosed herein are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

In some embodiments, non-limiting exemplary cytidine base editors (CBE) include BE1 (APOBEC1-XTEN-dCas9), BE2 (APOBEC1-XTEN-dCas9-UGI), BE3 (APOBEC1-XTEN-dCas9(A840H)-UGI), BE3-Gam, saBE3, saBE4-Gam, BE4, BE4-Gam, saBE4, or saB4E-Gam. BE4 extends the APOBEC1-Cas9n(D10A) linker to 32 amino acids and the Cas9n-UGI linker to 9 amino acids, and appends a second copy of UGI to the C-terminus of the construct with another 9-amino acid linker into a single base editor construct. The base editors saBE3 and saBE4 have the S. pyogenes Cas9n(D10A) replaced with the smaller S. aureus Cas9n(D10A). BE3-Gam, saBE3-Gam, BE4-Gam, and saBE4-Gam have 174 residues of Gam protein fused to the N-terminus of BE3, saBE3, BE4, and saBE4 via the 16 amino acid XTEN linker.

In some embodiments, the adenosine base editor (ABE) can deaminate adenine in DNA. In some embodiments, ABE is generated by replacing APOBEC1 component of BE3 with natural or engineered E. coli TadA, human ADAR2, mouse ADA, or human ADAT2. In some embodiments, ABE comprises evolved TadA variant. In some embodiments, the ABE is ABE 1.2 (TadA*-XTEN-nCas9-NLS). In some embodiments, TadA* comprises A106V and D108N mutations.

In some embodiments, the ABE is a second-generation ABE. In some embodiments, the ABE is ABE2.1, which comprises additional mutations D147Y and E155V in TadA* (TadA*2.1). In some embodiments, the ABE is ABE2.2, ABE2.1 fused to catalytically inactivated version of human alkyl adenine DNA glycosylase (AAG with E125Q mutation). In some embodiments, the ABE is ABE2.3, ABE2.1 fused to catalytically inactivated version of E. coli Endo V (inactivated with D35A mutation). In some embodiments, the ABE is ABE2.6 which has a linker twice as long (32 amino acids, $(SGGS)_2$ (SEQ ID NO: 1425)-XTEN-$(SGGS)_2$ (SEQ ID NO: 1425)) as the linker in ABE2.1. In some embodiments, the ABE is ABE2.7, which is ABE2.1 tethered with an additional wild-type TadA monomer. In some embodiments, the ABE is ABE2.8, which is ABE2.1 tethered with an additional TadA*2.1 monomer. In some embodiments, the ABE is ABE2.9, which is a direct fusion of evolved TadA (TadA*2.1) to the N-terminus of ABE2.1. In some embodiments, the ABE is ABE2.10, which is a direct fusion of wild-type TadA to the N-terminus of ABE2.1. In some embodiments, the ABE is ABE2.11, which is ABE2.9 with an inactivating E59A mutation at the N-terminus of TadA* monomer. In some embodiments, the ABE is ABE2.12, which is ABE2.9 with an inactivating E59A mutation in the internal TadA* monomer.

In some embodiments, the ABE is a third generation ABE. In some embodiments, the ABE is ABE3.1, which is ABE2.3 with three additional TadA mutations (L84F, H123Y, and 1156F).

In some embodiments, the ABE is a fourth generation ABE. In some embodiments, the ABE is ABE4.3, which is ABE3.1 with an additional TadA mutation A142N (TadA*4.3).

In some embodiments, the ABE is a fifth generation ABE. In some embodiments, the ABE is ABE5.1, which is generated by importing a consensus set of mutations from surviving clones (H36L, R51L, S146C, and K157N) into ABE3.1. In some embodiments, the ABE is ABE5.3, which has a heterodimeric construct containing wild-type E. coli TadA fused to an internal evolved TadA*. In some embodiments, the ABE is ABE5.2, ABE5.4, ABE5.5, ABE5.6, ABE5.7, ABE5.8, ABE5.9, ABE5.10, ABE5.11, ABE5.12, ABE5.13, or ABE5.14, as shown in Table 12 below. In some embodiments, the ABE is a sixth generation ABE. In some embodiments, the ABE is ABE6.1, ABE6.2, ABE6.3, ABE6.4, ABE6.5, or ABE6.6, as shown in Table 12 below. In some embodiments, the ABE is a seventh generation ABE. In some embodiments, the ABE is ABE7.1, ABE7.2, ABE7.3, ABE7.4, ABE7.5, ABE7.6, ABE7.7, ABE7.8, ABE7.9, or ABE7.10, as shown in Table 12 below.

TABLE 12

| | | | | | | | | | | | Genotypes of ABEs | | | | | | | | | |
|---|---|---|---|---|---|---|---|---|---|---|---|---|---|---|---|---|---|---|---|---|
| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
| ABE0.1 | W | R | H | N | P | | R | N | L | S | A | D | H | G | A | S | D | R | E | I | K | K |
| ABE0.2 | W | R | H | N | P | | R | N | L | S | A | D | H | G | A | S | D | R | E | I | K | K |
| ABE1.1 | W | R | H | N | P | | R | N | L | S | A | N | H | G | A | S | D | R | E | I | K | K |
| ABE1.2 | W | R | H | N | P | | R | N | L | S | V | N | H | G | A | S | D | R | E | I | K | K |
| ABE2.1 | W | R | H | N | P | | R | N | L | S | V | N | H | G | A | S | Y | R | V | I | K | K |
| ABE2.2 | W | R | H | N | P | | R | N | L | S | V | N | H | G | A | S | Y | R | V | I | K | K |
| ABE2.3 | W | R | H | N | P | | R | N | L | S | V | N | H | G | A | S | Y | R | V | I | K | K |
| ABE2.4 | W | R | H | N | P | | R | N | L | S | V | N | H | G | A | S | Y | R | V | I | K | K |
| ABE2.5 | W | R | H | N | P | | R | N | L | S | V | N | H | G | A | S | Y | R | V | I | K | K |
| ABE2.6 | W | R | H | N | P | | R | N | L | S | V | N | H | G | A | S | Y | R | V | I | K | K |
| ABE2.7 | W | R | H | N | P | | R | N | L | S | V | N | H | G | A | S | Y | R | V | I | K | K |
| ABE2.8 | W | R | H | N | P | | R | N | L | S | V | N | H | G | A | S | Y | R | V | I | K | K |
| ABE2.9 | W | R | H | N | P | | R | N | L | S | V | N | H | G | A | S | Y | R | V | I | K | K |
| ABE2.10 | W | R | H | N | P | | R | N | L | S | V | N | H | G | A | S | Y | R | V | I | K | K |
| ABE2.11 | W | R | H | N | P | | R | N | L | S | V | N | H | G | A | S | Y | R | V | I | K | K |
| ABE2.12 | W | R | H | N | P | | R | N | L | S | V | N | H | G | A | S | Y | R | V | I | K | K |
| ABE3.1 | W | R | H | N | P | | R | N | F | S | V | N | Y | G | A | S | Y | R | V | F | K | K |
| ABE3.2 | W | R | H | N | P | | R | N | F | S | V | N | Y | G | A | S | Y | R | V | F | K | K |
| ABE3.3 | W | R | H | N | P | | R | N | F | S | V | N | Y | G | A | S | Y | R | V | F | K | K |
| ABE3.4 | W | R | H | N | P | | R | N | F | S | V | N | Y | G | A | S | Y | R | V | F | K | K |
| ABE3.5 | W | R | H | N | P | | R | N | F | S | V | N | Y | G | A | S | Y | R | V | F | K | K |
| ABE3.6 | W | R | H | N | P | | R | N | F | S | V | N | Y | G | A | S | Y | R | V | F | K | K |
| ABE3.7 | W | R | H | N | P | | R | N | F | S | V | N | Y | G | A | S | Y | R | V | F | K | K |

TABLE 12-continued

Genotypes of ABEs

| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
|---|---|---|---|---|---|---|---|---|---|---|---|---|---|---|---|---|---|---|---|---|---|---|
| ABE3.8 | W | R | H | N | P | | R | N | F | S | V | N | Y | G | A | S | Y | R | V | F | K | K |
| ABE4.1 | W | R | H | N | P | | R | N | L | S | V | N | H | G | N | S | Y | R | V | I | K | K |
| ABE4.2 | W | G | H | N | P | | R | N | L | S | V | N | H | G | N | S | Y | R | V | I | K | K |
| ABE4.3 | W | R | H | N | P | | R | N | F | S | V | N | Y | G | N | S | Y | R | V | F | K | K |
| ABE5.1 | W | R | L | N | P | | L | N | F | S | V | N | Y | G | A | C | Y | R | V | F | N | K |
| ABE5.2 | W | R | H | S | P | | R | N | F | S | V | N | Y | G | A | S | Y | R | V | F | K | T |
| ABE5.3 | W | R | L | N | P | | L | N | I | S | V | N | Y | G | A | C | Y | R | V | I | N | K |
| ABE5.4 | W | R | H | S | P | | R | N | F | S | V | N | Y | G | A | S | Y | R | V | F | K | T |
| ABE5.5 | W | R | L | N | P | | L | N | F | S | V | N | Y | G | A | C | Y | R | V | F | N | K |
| ABE5.6 | W | R | L | N | P | | L | N | F | S | V | N | Y | G | A | C | Y | R | V | F | N | K |
| ABE5.7 | W | R | L | N | P | | L | N | F | S | V | N | Y | G | A | C | Y | R | V | F | N | K |
| ABE5.8 | W | R | L | N | P | | L | N | F | S | V | N | Y | G | A | C | Y | R | V | F | N | K |
| ABE5.9 | W | R | L | N | P | | L | N | F | S | V | N | Y | G | A | C | Y | R | V | F | N | K |
| ABE5.10 | W | R | L | N | P | | L | N | F | S | V | N | Y | G | A | C | Y | R | V | F | N | K |
| ABE5.11 | W | R | L | N | P | | L | N | F | S | V | N | Y | G | A | C | Y | R | V | F | N | K |
| ABE5.12 | W | R | L | N | P | | L | N | F | S | V | N | Y | G | A | C | Y | R | V | F | N | K |
| ABE5.13 | W | R | H | N | P | | L | D | F | S | V | N | Y | A | A | S | Y | R | V | F | K | K |
| ABE5.14 | W | R | H | N | S | | L | N | F | C | V | N | Y | G | A | S | Y | R | V | F | K | K |
| ABE6.1 | W | R | H | N | S | | L | N | F | S | V | N | Y | G | N | S | Y | R | V | F | K | K |
| ABE6.2 | W | R | H | N | T | V | L | N | F | S | V | N | Y | G | N | S | Y | R | V | F | N | K |
| ABE6.3 | W | R | L | N | S | | L | N | F | S | V | N | Y | G | A | C | Y | R | V | F | N | K |
| ABE6.4 | W | R | L | N | S | | L | N | F | S | V | N | Y | G | N | C | Y | R | V | F | N | K |
| ABE6.5 | W | R | L | N | T | V | L | N | F | S | V | N | Y | G | A | C | Y | R | V | F | N | K |
| ABE6.6 | W | R | L | N | T | V | L | N | F | S | V | N | Y | G | N | C | Y | R | V | F | N | K |
| ABE7.1 | W | R | L | N | A | | L | N | F | S | V | N | Y | G | A | C | Y | R | V | F | N | K |
| ABE7.2 | W | R | L | N | A | | L | N | F | S | V | N | Y | G | N | C | Y | R | V | F | N | K |
| ABE7.3 | L | R | L | N | A | | L | N | F | S | V | N | Y | G | A | C | Y | R | V | F | N | K |
| ABE7.4 | R | R | L | N | A | | L | N | F | S | V | N | Y | G | A | C | Y | R | V | F | N | K |
| ABE7.5 | W | R | L | N | A | | L | N | F | S | V | N | Y | G | A | C | Y | H | V | F | N | K |
| ABE7.6 | W | R | L | N | A | | L | N | I | S | V | N | Y | G | A | C | Y | P | V | F | N | K |
| ABE7.7 | L | R | L | N | A | | L | N | F | S | V | N | Y | G | A | C | Y | P | V | F | N | K |
| ABE7.8 | L | R | L | N | A | | L | N | F | S | V | N | Y | G | N | C | Y | R | V | F | N | K |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

In some embodiments, the base editor is an eighth generation ABE (ABE8). In some embodiments, the ABE8 contains a TadA*8 variant. In some embodiments, the ABE8 has a monomeric construct containing a TadA*8 variant ("ABE8.x-m"). In some embodiments, the ABE8 is ABE8.1-m, which has a monomeric construct containing TadA*7.10 with a YT47T mutation (TadA*8.1). In some embodiments, the ABE8 is ABE8.2-m, which has a monomeric construct containing TadA*7.10 with a Y147R mutation (TadA*8.2). In some embodiments, the ABE8 is ABE8.3-m, which has a monomeric construct containing TadA*7.10 with a Q154S mutation (TadA*8.3). In some embodiments, the ABE8 is ABE8.4-m, which has a monomeric construct containing TadA*7.10 with a Y123H mutation (TadA*8.4). In some embodiments, the ABE8 is ABE8.5-m, which has a monomeric construct containing TadA*7.10 with a V82S mutation (TadA*8.5). In some embodiments, the ABE8 is ABE8.6-m, which has a monomeric construct containing TadA*7.10 with a T166R mutation (TadA*8.6). In some embodiments, the ABE8 is ABE8.7-m, which has a monomeric construct containing TadA*7.10 with a Q154R mutation (TadA*8.7). In some embodiments, the ABE8 is ABE8.8-m, which has a monomeric construct containing TadA*7.10 with Y147R, Q154R, and Y123H mutations (TadA*8.8). In some embodiments, the ABE8 is ABE8.9-m, which has a monomeric construct containing TadA*7.10 with Y147R, Q154R and I76Y mutations (TadA*8.9). In some embodiments, the ABE8 is ABE8.10-m, which has a monomeric construct containing TadA*7.10 with Y147R, Q154R, and T166R mutations (TadA*8.10). In some embodiments, the ABE8 is ABE8.11-m, which has a monomeric construct containing TadA*7.10 with Y147T and Q154R mutations (TadA*8.11). In some embodiments, the ABE8 is ABE8.12-m, which has a monomeric construct containing TadA*7.10 with Y147T and Q154S mutations (TadA*8.12).

In some embodiments, the ABE8 is ABE8.13-m, which has a monomeric construct containing TadA*7.10 with Y123H (Y123H reverted from H123Y), Y147R, Q154R and I76Y mutations (TadA*8.13). In some embodiments, the ABE8 is ABE8.14-m, which has a monomeric construct containing TadA*7.10 with I76Y and V82S mutations (TadA*8.14). In some embodiments, the ABE8 is ABE8.15-m, which has a monomeric construct containing TadA*7.10 with V82S and Y147R mutations (TadA*8.15). In some embodiments, the ABE8 is ABE8.16-m, which has a monomeric construct containing TadA*7.10 with V82S, Y123H (Y123H reverted from H123Y) and Y147R mutations (TadA*8.16). In some embodiments, the ABE8 is ABE8.17-m, which has a monomeric construct containing TadA*7.10 with V82S and Q154R mutations (TadA*8.17). In some embodiments, the ABE8 is ABE8.18-m, which has a monomeric construct containing TadA*7.10 with V82S, Y123H (Y123H reverted from H123Y) and Q154R mutations (TadA*8.18). In some embodiments, the ABE8 is ABE8.19-m, which has a monomeric construct containing TadA*7.10 with V82S, Y123H (Y123H reverted from H123Y), Y147R and Q154R mutations (TadA*8.19). In some embodiments, the ABE8 is ABE8.20-m, which has a monomeric construct containing TadA*7.10 with I76Y, V82S, Y123H (Y123H reverted from H123Y), Y147R and Q154R mutations (TadA*8.20). In some embodiments, the ABE8 is ABE8.21-m, which has a monomeric construct containing TadA*7.10 with Y147R and Q154S mutations (TadA*8.21). In some embodiments, the ABE8 is ABE8.22-m, which has a monomeric construct containing TadA*7.10 with V82S and Q154S mutations (TadA*8.22). In some embodiments, the ABE8 is ABE8.23-m, which has a monomeric construct containing TadA*7.10 with V82S and Y123H (Y123H reverted from H123Y) mutations (TadA*8.23). In some embodiments, the ABE8 is ABE8.24-m, which has a monomeric construct containing TadA*7.10 with V82S, Y123H (Y123H reverted from H123Y), and Y147T mutations (TadA*8.24).

In some embodiments, the ABE8 has a heterodimeric construct containing wild-type E. coli TadA fused to a TadA*8 variant ("ABE8.x-d"). In some embodiments, the ABE8 is ABE8.1-d, which has a heterodimeric construct containing wild-type E. coli TadA fused to TadA*7.10 with a Y147T mutation (TadA*8.1). In some embodiments, the ABE8 is ABE8.2-d, which has a heterodimeric construct containing wild-type E. coli TadA fused to TadA*7.10 with a Y147R mutation (TadA*8.2). In some embodiments, the ABE8 is ABE8.3-d, which has a heterodimeric construct containing wild-type E. coli TadA fused to TadA*7.10 with a Q154S mutation (TadA*8.3). In some embodiments, the ABE8 is ABE8.4-d, which has a heterodimeric construct containing wild-type E. coli TadA fused to TadA*7.10 with a Y123H mutation (TadA*8.4). In some embodiments, the ABE8 is ABE8.5-d, which has a heterodimeric construct containing wild-type E. coli TadA fused to TadA*7.10 with a V82S mutation (TadA*8.5). In some embodiments, the ABE8 is ABE8.6-d, which has a heterodimeric construct containing wild-type E. coli TadA fused to TadA*7.10 with a T166R mutation (TadA*8.6). In some embodiments, the ABE8 is ABE8.7-d, which has a heterodimeric construct containing wild-type E. coli TadA fused to TadA*7.10 with a Q154R mutation (TadA*8.7). In some embodiments, the ABE8 is ABE8.8-d, which has a heterodimeric construct containing wild-type E. coli TadA fused to TadA*7.10 with Y147R, Q154R, and Y123H mutations (TadA*8.8). In some embodiments, the ABE8 is ABE8.9-d, which has a heterodimeric construct containing wild-type E. coli TadA fused to TadA*7.10 with Y147R, Q154R and I76Y mutations (TadA*8.9). In some embodiments, the ABE8 is ABE8.10-d, which has a heterodimeric construct containing wild-type E. coli TadA fused to TadA*7.10 with Y147R, Q154R, and T166R mutations (TadA*8.10). In some embodiments, the ABE8 is ABE8.11-d, which has a heterodimeric construct containing wild-type E. coli TadA fused to TadA*7.10 with Y147T and Q154R mutations (TadA*8.11). In some embodiments, the ABE8 is ABE8.12-d, which has heterodimeric construct containing wild-type E. coli TadA fused to TadA*7.10 with Y147T and Q154S mutations (TadA*8.12). In some embodiments, the ABE8 is ABE8.13-d, which has a heterodimeric construct containing wild-type E. coli TadA fused to TadA*7.10 with Y123H (Y123H reverted from H123Y), Y147R, Q154R and I76Y mutations (TadA*8.13). In some embodiments, the ABE8 is ABE8.14-d, which has a heterodimeric construct containing wild-type E. coli TadA fused to TadA*7.10 with I76Y and V82S mutations (TadA*8.14). In some embodiments, the ABE8 is ABE8.15-d, which has a heterodimeric construct containing wild-type E. coli TadA fused to TadA*7.10 with V82S and Y147R mutations (TadA*8.15). In some embodiments, the ABE8 is ABE8.16-d, which has a heterodimeric construct containing wild-type E. coli TadA fused to TadA*7.10 with V82S, Y123H (Y123H reverted from H123Y) and Y147R mutations (TadA*8.16). In some embodiments, the ABE8 is ABE8.17-d, which has a heterodimeric construct containing wild-type E. coli TadA fused to TadA*7.10 with V82S and Q154R mutations (TadA*8.17). In some embodiments, the ABE8 is ABE8.18-d, which has a heterodimeric construct containing wild-type E. coli TadA fused to TadA*7.10 with V82S, Y123H (Y123H reverted from H123Y) and Q154R mutations (TadA*8.18). In some embodiments, the ABE8 is ABE8.19-d, which has a heterodimeric construct containing wild-type E. coli TadA fused to TadA*7.10 with V82S, Y123H (Y123H reverted from H123Y), Y147R and Q154R mutations (TadA*8.19). In some embodiments, the ABE8 is ABE8.20-d, which has a heterodimeric construct containing wild-type E. coli TadA fused to TadA*7.10 with I76Y, V82S, Y123H (Y123H reverted from H123Y), Y147R and Q154R mutations (TadA*8.20). In some embodiments, the ABE8 is ABE8.21-d, which has a heterodimeric construct containing wild-type E. coli TadA fused to TadA*7.10 with Y147R and Q154S mutations (TadA*8.21). In some embodiments, the ABE8 is ABE8.22-d, which has a heterodimeric construct containing wild-type E. coli TadA fused to TadA*7.10 with V82S and Q154S mutations (TadA*8.22). In some embodiments, the ABE8 is ABE8.23-d, which has a heterodimeric construct containing wild-type E. coli TadA fused to TadA*7.10 with V82S and Y123H (Y123H reverted from H123Y) mutations (TadA*8.23). In some embodiments, the ABE8 is ABE8.24-d, which has a heterodimeric construct containing wild-type E. coli TadA fused to TadA*7.10 with V82S, Y123H (Y123H reverted from H123Y), and Y147T mutations (TadA*8.24).

In some embodiments, the ABE8 has a heterodimeric construct containing TadA*7.10 fused to a TadA*8 variant ("ABE8.x-7"). In some embodiments, the ABE8 is ABE8.1-7, which has a heterodimeric construct containing TadA*7.10 fused to TadA*7.10 with a Y147T mutation (TadA*8.1). In some embodiments, the ABE8 is ABE8.2-7, which has a heterodimeric construct containing TadA*7.10 fused to TadA*7.10 with a Y147R mutation (TadA*8.2). In some embodiments, the ABE8 is ABE8.3-7, which has a heterodimeric construct containing TadA*7.10 fused to TadA*7.10 with a Q154S mutation (TadA*8.3). In some embodiments, the ABE8 is ABE8.4-7, which has a heterodimeric construct containing TadA*7.10 fused to TadA*7.10 with a Y123H mutation (TadA*8.4). In some embodiments, the ABE8 is ABE8.5-7, which has a heterodimeric construct containing TadA*7.10 fused to TadA*7.10 with a V82S mutation (TadA*8.5). In some embodiments, the ABE8 is ABE8.6-7, which has a heterodimeric construct containing TadA*7.10 fused to TadA*7.10 with a T166R mutation (TadA*8.6). In some embodiments, the ABE8 is ABE8.7-7, which has a heterodimeric construct containing TadA*7.10 fused to TadA*7.10 with a Q154R mutation (TadA*8.7). In some embodiments, the ABE8 is ABE8.8-7, which has a heterodimeric construct containing TadA*7.10 fused to TadA*7.10 with Y147R, Q154R, and Y123H mutations (TadA*8.8). In some embodiments, the ABE8 is ABE8.9-7, which has a heterodimeric construct containing TadA*7.10 fused to TadA*7.10 with Y147R, Q154R and I76Y mutations (TadA*8.9). In some embodiments, the ABE8 is ABE8.10-7, which has a heterodimeric construct containing TadA*7.10 fused to TadA*7.10 with Y147R, Q154R, and T166R mutations (TadA*8.10). In some embodiments, the ABE8 is ABE8.11-7, which has a heterodimeric construct containing TadA*7.10 fused to TadA*7.10 with Y147T and Q154R mutations (TadA*8.11). In some embodiments, the ABE8 is ABE8.12-7, which has a heterodimeric construct containing TadA*7.10 fused to TadA*7.10 with Y147T and Q154S mutations (TadA*8.12). In some embodiments, the ABE8 is ABE8.13-7, which has a heterodimeric construct containing TadA*7.10 fused to TadA*7.10 with Y123H (Y123H reverted from H123Y), Y147R, Q154R and I76Y mutations (TadA*8.13). In some embodiments, the ABE8 is ABE8.14-7, which has a heterodimeric construct containing TadA*7.10 fused to TadA*7.10 with I76Y and V82S mutations (TadA*8.14). In some embodiments, the ABE8 is ABE8.15-7, which has a heterodimeric construct containing TadA*7.10 fused to TadA*7.10 with V82S and Y147R mutations (TadA*8.15). In some embodiments, the ABE8 is ABE8.16-7, which has a heterodimeric construct containing TadA*7.10 fused to TadA*7.10 with V82S, Y123H (Y123H reverted from H123Y) and Y147R mutations (TadA*8.16). In some embodiments, the ABE8 is ABE8.17-7, which has a heterodimeric construct containing TadA*7.10 fused to TadA*7.10 with V82S and Q154R mutations (TadA*8.17). In some embodiments, the ABE8 is ABE8.18-7, which has a heterodimeric construct containing TadA*7.10 fused to TadA*7.10 with V82S, Y123H (Y123H reverted from H123Y) and Q154R mutations (TadA*8.18). In some embodiments, the ABE8 is ABE8.19-7, which has a heterodimeric construct containing TadA*7.10 fused to TadA*7.10 with V82S, Y123H (Y123H reverted from H123Y), Y147R and Q154R mutations (TadA*8.19). In some embodiments, the ABE8 is ABE8.20-7, which has a heterodimeric construct containing TadA*7.10 fused to TadA*7.10 with I76Y, V82S, Y123H (Y123H reverted from H123Y), Y147R and Q154R mutations (TadA*8.20). In some embodiments, the ABE8 is ABE8.21-7, which has a heterodimeric construct containing TadA*7.10 fused to TadA*7.10 with Y147R and Q154S mutations (TadA*8.21). In some embodiments, the ABE8 is ABE8.22-7, which has a heterodimeric construct containing TadA*7.10 fused to TadA*7.10 with V82S and Q154S mutations (TadA*8.22). In some embodiments, the ABE8 is ABE8.23-7, which has a heterodimeric construct containing TadA*7.10 fused to TadA*7.10 with V82S and Y123H (Y123H reverted from H123Y) mutations (TadA*8.23). In some embodiments, the ABE8 is ABE8.24-7, which has a heterodimeric construct containing TadA*7.10 fused to TadA*7.10 with V82S, Y123H (Y123H reverted from H123Y), and Y147T mutations (TadA*8.24

In some embodiments, the ABE is ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, ABE8.24-m, ABE8.1-d, ABE8.2-d, ABE8.3-d, ABE8.4-d, ABE8.5-d, ABE8.6-d, ABE8.7-d, ABE8.8-d, ABE8.9-d, ABE8.10-d, ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d as shown in Table 13 below.

TABLE 13

Adenosine Deaminase Base Editor 8 (ABE8) Variants

| ABE8 | Adenosine Deaminase | Adenosine Deaminase Description |
|---|---|---|
| ABE8.1-m | TadA*8.1 | Monomer_TadA*7.10 + Y147T |
| ABE8.2-m | TadA*8.2 | Monomer_TadA*7.10 + Y147R |
| ABE8.3-m | TadA*8.3 | Monomer_TadA*7.10 + Q154S |
| ABE8.4-m | TadA*8.4 | Monomer_TadA*7.10 + Y123H |
| ABE8.5-m | TadA*8.5 | Monomer_TadA*7.10 + V82S |
| ABE8.6-m | TadA*8.6 | Monomer_TadA*7.10 + T166R |
| ABE8.7-m | TadA*8.7 | Monomer_TadA*7.10 + Q154R |
| ABE8.8-m | TadA*8.8 | Monomer_TadA*7.10 + Y147R_Q154R_Y123H |
| ABE8.9-m | TadA*8.9 | Monomer_TadA*7.10 + Y147R_Q154R_I76Y |
| ABE8.10-m | TadA*8.10 | Monomer_TadA*7.10 + Y147R_Q154R_T166R |
| ABE8.11-m | TadA*8.11 | Monomer_TadA*7.10 + Y147T_Q154R |
| ABE8.12-m | TadA*8.12 | Monomer_TadA*7.10 + Y147T_Q154S |
| ABE8.13-m | TadA*8.13 | Monomer_TadA*7.10 + Y123H_Y147R_Q154R_I76Y |
| ABE8.14-m | TadA*8.14 | Monomer_TadA*7.10 + I76Y_V82S |
| ABE8.15-m | TadA*8.15 | Monomer_TadA*7.10 + V82S_Y147R |
| ABE8.16-m | TadA*8.16 | Monomer_TadA*7.10 + V82S_Y123H_Y147R |
| ABE8.17-m | TadA*8.17 | Monomer_TadA*7.10 + V82S_Q154R |
| ABE8.18-m | TadA*8.18 | Monomer_TadA*7.10 + V82S_Y123H_Q154R |
| ABE8.19-m | TadA*8.19 | Monomer_TadA*7.10 + V82S_Y123H_Y147R_Q154R |
| ABE8.20-m | TadA*8.20 | Monomer_TadA*7.10 + I76Y_V82S_Y123H_Y147R_Q154R |
| ABE8.21-m | TadA*8.21 | Monomer_TadA*7.10 + Y147R_Q154S |
| ABE8.22-m | TadA*8.22 | Monomer_TadA*7.10 + V82S_Q154S |
| ABE8.23-m | TadA*8.23 | Monomer_TadA*7.10 + V82S_Y123H |
| ABE8.24-m | TadA*8.24 | Monomer_TadA*7.10 + V82S_Y123H_Y147T |
| ABE8.1-d | TadA*8.1 | Heterodimer_(WT) + (TadA*7.10 + Y147T) |
| ABE8.2-d | TadA*8.2 | Heterodimer_(WT) + (TadA*7.10 + Y147R) |
| ABE8.3-d | TadA*8.3 | Heterodimer_(WT) + (TadA*7.10 + Q154S) |
| ABE8.4-d | TadA*8.4 | Heterodimer_(WT) + (TadA*7.10 + Y123H) |
| ABE8.5-d | TadA*8.5 | Heterodimer_(WT) + (TadA*7.10 + V82S) |
| ABE8.6-d | TadA*8.6 | Heterodimer_(WT) + (TadA*7.10 + T166R) |
| ABE8.7-d | TadA*8.7 | Heterodimer_(WT) + (TadA*7.10 + Q154R) |
| ABE8.8-d | TadA*8.8 | Heterodimer_(WT) + (TadA*7.10 + Y147R_Q154R_Y123H) |
| ABE8.9-d | TadA*8.9 | Heterodimer_(WT) + (TadA*7.10 + Y147R_Q154R_I76Y) |
| ABE8.10-d | TadA*8.10 | Heterodimer_(WT) + (TadA*7.10 + Y147R_Q154R_T166R) |
| ABE8.11-d | TadA*8.11 | Heterodimer_(WT) + (TadA*7.10 + Y147T_Q154R) |
| ABE8.12-d | TadA*8.12 | Heterodimer_(WT) + (TadA*7.10 + Y147T_Q154S) |
| ABE8.13-d | TadA*8.13 | Heterodimer_(WT) + (TadA*7.10 + Y123H_Y147T_Q154R_I76Y) |
| ABE8.14-d | TadA*8.14 | Heterodimer_(WT) + (TadA*7.10 + I76Y_V82S) |
| ABE8.15-d | TadA*8.15 | Heterodimer_(WT) + (TadA*7.10 + V82S_Y147R) |
| ABE8.16-d | TadA*8.16 | Heterodimer_(WT) + (TadA*7.10 + V82S_Y123H_Y147R) |
| ABE8.17-d | TadA*8.17 | Heterodimer_(WT) + (TadA*7.10 + V82S_Q154R) |
| ABE8.18-d | TadA*8.18 | Heterodimer_(WT) + (TadA*7.10 + V82S_Y123H_Q154R) |

TABLE 13-continued

| | | Adenosine Deaminase Base Editor 8 (ABE8) Variants |
|---|---|---|
| ABE8 | Adenosine Deaminase | Adenosine Deaminase Description |
| ABE8.19-d | TadA*8.19 | Heterodimer_(WT) + (TadA*7.10 + V82S__Y123H__Y147R__Q154R) |
| ABE8.20-d | TadA*8.20 | Heterodimer_(WT) + (TadA*7.10 + I76Y__V82S__Y123H__Y147R__Q154R) |
| ABE8.21-d | TadA*8.21 | Heterodimer_(WT) + (TadA*7.10 + Y147R__Q154S) |
| ABE8.22-d | TadA*8.22 | Heterodimer_(WT) + (TadA*7.10 + V82S__Q154S) |
| ABE8.23-d | TadA*8.23 | Heterodimer_(WT) + (TadA*7.10 + V82S__Y123H) |
| ABE8.24-d | TadA*8.24 | Heterodimer_(WT) + (TadA*7.10 + V82S__Y123H__Y147T) |

In some embodiments, the ABE8 is ABE8a-m, which has a monomeric construct containing TadA*7.10 with R26C, A109S, T111R, D119N, H122N, Y147D, F149Y, T166I, and D167N mutations (TadA*8a). In some embodiments, the ABE8 is ABE8b-m, which has a monomeric construct containing TadA*7.10 with V88A, A109S, T111R, D119N, H122N, F149Y, T166I, and D167N mutations (TadA*8b). In some embodiments, the ABE8 is ABE8c-m, which has a monomeric construct containing TadA*7.10 with R26C, A109S, T111R, D119N, H122N, F149Y, T166I, and D167N mutations (TadA*8c). In some embodiments, the ABE8 is ABE8d-m, which has a monomeric construct containing TadA*7.10 with V88A, T111R, D119N, and F149Y mutations (TadA*8d). In some embodiments, the ABE8 is ABE8e-m, which has a monomeric construct containing TadA*7.10 with A109S, T111R, D119N, H122N, Y147D, F149Y, T166I, and D167N mutations (TadA*8e).

In some embodiments, the ABE8 is ABE8a-d, which has a heterodimeric construct containing wild-type E. coli TadA fused to TadA*7.10 with R26C, A109S, T111R, D119, H122N, Y147D, F149Y, T166I, and D167N mutations (TadA*8a). In some embodiments, the ABE8 is ABE8b-d, which has a heterodimeric construct containing wild-type E. coli TadA fused to TadA*7.10 with V88A, A109S, T111R, D119N, H122N, F149Y, T166I, and D167N mutations (TadA*8b). In some embodiments, the ABE8 is ABE8c-d, which has a heterodimeric construct containing wild-type E. coli TadA fused to TadA*7.10 with R26C, A109S, T111R, D119N, H122N, F149Y, T166I, and D167N mutations (TadA*8c). In some embodiments, the ABE8 is ABE8d-d, which has a heterodimeric construct containing wild-type E. coli TadA fused to TadA*7.10 with V88A, T111R, D119N, and F149Y mutations (TadA*8d). In some embodiments, the ABE8 is ABE8e-d, which has a heterodimeric construct containing wild-type E. coli TadA fused to TadA*7.10 with A109S, T111R, D119N, H122N, Y147D, F149Y, T166I, and D167N mutations (TadA*8e).

In some embodiments, the ABE8 is ABE8a-7, which has a heterodimeric construct containing TadA*7.10 fused to TadA*7.10 with R26C, A109S, T111R, D119, H122N, Y147D, F149Y, T166I, and D167N mutations (TadA*8a). In some embodiments, the ABE8 is ABE8b-7, which has a heterodimeric construct containing TadA*7.10 fused to TadA*7.10 with V88A, A109S, T111R, D119N, H122N, F149Y, T166I, and D167N mutations (TadA*8b). In some embodiments, the ABE8 is ABE8c-7, which has a heterodimeric construct containing TadA*7.10 fused to TadA*7.10 with R26C, A109S, T111R, D119N, H122N, F149Y, T166I, and D167N mutations (TadA*8c). In some embodiments, the ABE8 is ABE8d-7, which has a heterodimeric construct containing TadA*7.10 fused to TadA*7.10 with V88A, T111R, Di 19N, and F149Y mutations (TadA*8d). In some embodiments, the ABE8 is ABE8e-7, which has a heterodimeric construct containing TadA*7.10 fused to TadA*7.10 with A109S, T111R, D119N, H122N, Y147D, F149Y, T166I, and D167N mutations (TadA*8e). In some embodiments, the ABE is ABE8a-m, ABE8b-m, ABE8c-m, ABE8d-m, ABE8e-m, ABE8a-d, ABE8b-d, ABE8c-d, ABE8d-d, or ABE8e-d, as shown in Table 14 below. In some embodiments, the ABE is ABE8e-m or ABE8e-d. ABE8e shows efficient adenine base editing activity and low indel formation when used with Cas homologues other than SpCas9, for example, SaCas9, SaCas9-KKH, Cas12a homologues, e.g., LbCas12a, enAs-Cas12a, SpCas9-NG and circularly permuted CP1028-SpCas9 and CP1041-SpCas9. In addition to the mutations shown for ABE8e in Table 14, off-target RNA and DNA editing were reduced by introducing a V106W substitution into the TadA domain (as described in M. Richter et al., 2020, Nature Biotechnology, doi.org/10.1038/s41587-020-0453-z, the entire contents of which are incorporated by reference herein).

TABLE 14

| | | Additional Adenosine Deaminase Base Editor 8 Variants |
|---|---|---|
| ABE8 Base Editor | Adenosine Deaminase | Adenosine Deaminase Description |
| ABE8a-m | TadA*8a | Monomer_TadA*7.10 + R26C + A109S + T111R + D119N + H122N + Y147D + F149Y + T166I + D167N |
| ABE8b-m | TadA*8b | Monomer_TadA*7.10 + V88A + A109S + T111R + D119N + H122N + F149Y + T166I + D167N |
| ABE8c-m | TadA*8c | Monomer_TadA*7.10 + R26C + A109S + T111R + D119N + H122N + F149Y + T166I + D167N |
| ABE8d-m | TadA*8d | Monomer_TadA*7.10 + V88A + T111R + D119N + F149Y |
| ABE8e-m | TadA*8e | Monomer_TadA*7.10 + A109S + T111R + D119N + H122N + Y147D + F149Y + T166I + D167N |
| ABE8a-d | TadA*8a | Heterodimer_(WT) + (TadA*7.10 + R26C + A109S + T111R + D119N + H122N + Y147D + F149Y + T166I + D167N) |
| ABE8b-d | TadA*8b | Heterodimer_(WT) + (TadA*7.10 + V88A + A109S + T111R + D119N + H122N + F149Y + T166I + D167N) |

TABLE 14-continued

| Additional Adenosine Deaminase Base Editor 8 Variants | | |
|---|---|---|
| ABE8 Base Editor | Adenosine Deaminase | Adenosine Deaminase Description |
| ABE8c-d | TadA*8c | Heterodimer_(WT) + (TadA*7.10 + R26C + A109S + T111R + D119N + H122N + F149Y + T166I + D167N) |
| ABE8d-d | TadA*8d | Heterodimer_(WT) + (TadA*7.10 + V88A + T111R + D119N + F149Y) |
| ABE8e-d | TadA*8e | Heterodimer_(WT) + (TadA*7.10 + A109S + T111R + D119N + H122N + Y147D + F149Y + T166I + D167N) |

In some embodiments, base editors (e.g., ABE8) are generated by cloning an adenosine deaminase variant (e.g., TadA*8) into a scaffold that includes a circular permutant Cas9 (e.g. CP5 or CP6) and a bipartite nuclear localization sequence. In some embodiments, the base editor (e.g., ABE7.9, ABE7.10, or ABE8) is an NGC PAM CP5 variant (*S. pyogenes* Cas9 or spVRQR Cas9). In some embodiments, the base editor (e.g., ABE7.9, ABE7.10, or ABE8) is an AGA PAM CP5 variant (*S. pyogenes* Cas9 or spVRQR Cas9). In some embodiments, the base editor (e.g., ABE7.9, ABE7.10, or ABE8) is an NGC PAM CP6 variant (*S. pyogenes* Cas9 or spVRQR Cas9). In some embodiments, the base editor (e.g. ABE7.9, ABE7.10, or ABE8) is an AGA PAM CP6 variant (*S. pyogenes* Cas9 or spVRQR Cas9).

In some embodiments, the ABE has a genotype as shown in Table 15 below.

TABLE 15

| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
|---|---|---|---|---|---|---|---|---|---|---|---|---|---|---|---|---|---|---|---|---|---|---|
| | | | | | | | | | | | | | Genotypes of ABEs | | | | | | | | | |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

As shown in Table 16 below, genotypes of 40 ABE8s are described. Residue positions in the evolved *E. coli* TadA portion of ABE are indicated. Mutational changes in ABE8 are shown when distinct from ABE7.10 mutations. In some embodiments, the ABE has a genotype of one of the ABEs as shown in Table 16 below.

TABLE 16

| | 23 | 36 | 48 | 51 | 76 | 82 | 84 | 106 | 108 | 123 | 146 | 147 | 152 | 154 | 155 | 156 | 157 | 166 |
|---|---|---|---|---|---|---|---|---|---|---|---|---|---|---|---|---|---|---|
| | | | | | | | | Residue Identity in Evolved TadA | | | | | | | | | | |
| ABE7.10 | R | L | A | L | I | V | F | V | N | Y | C | Y | P | Q | V | F | N | T |
| ABE8.1-m | | | | | | | | | | | | T | | | | | | |
| ABE8.2-m | | | | | | | | | | | | R | | | | | | |
| ABE8.3-m | | | | | | | | | | | | | | S | | | | |
| ABE8.4-m | | | | | | | | | | H | | | | | | | | |
| ABE8.5-m | | | | | | S | | | | | | | | | | | | |
| ABE8.6-m | | | | | | | | | | | | | | | | | | R |
| ABE8.7-m | | | | | | | | | | | | | | R | | | | |
| ABE8.8-m | | | | | | | | | | H | | R | | R | | | | |
| ABE8.9-m | | | | | Y | | | | | | | R | | R | | | | |
| ABE8.10-m | | | | | | | | | | | | R | | R | | | | R |
| ABE8.11-m | | | | | | | | | | | | T | | R | | | | |
| ABE8.12-m | | | | | | | | | | | | T | | S | | | | |
| ABE8.13-m | | | | | Y | | | | | H | | R | | R | | | | |
| ABE8.14-m | | | | | Y | S | | | | | | | | | | | | |
| ABE8.15-m | | | | | | S | | | | | | R | | | | | | |
| ABE8.16-m | | | | | | S | | | | H | | R | | | | | | |
| ABE8.17-m | | | | | | S | | | | | | | | R | | | | |
| ABE8.18-m | | | | | | S | | | | H | | | | R | | | | |
| ABE8.19-m | | | | | | S | | | | H | | R | | R | | | | |
| ABE8.20-m | | | | | Y | S | | | | H | | R | | R | | | | |
| ABE8.21-m | | | | | | | | | | | | R | | S | | | | |
| ABE8.22-m | | | | | | S | | | | | | | | S | | | | |
| ABE8.23-m | | | | | | S | | | | H | | | | | | | | |
| ABE8.24-m | | | | | | S | | | | H | | T | | | | | | |
| ABE8.1-d | | | | | | | | | | | | T | | | | | | |
| ABE8.2-d | | | | | | | | | | | | R | | | | | | |
| ABE8.3-d | | | | | | | | | | | | | | S | | | | |
| ABE8.4-d | | | | | | | | | | H | | | | | | | | |
| ABE8.5-d | | | | | | S | | | | | | | | | | | | |

TABLE 16-continued

| | 23 | 36 | 48 | 51 | 76 | 82 | 84 | 106 | 108 | 123 | 146 | 147 | 152 | 154 | 155 | 156 | 157 | 166 |
|---|---|---|---|---|---|---|---|---|---|---|---|---|---|---|---|---|---|---|
| | | | | | | | | Residue Identity in Evolved TadA | | | | | | | | | | |
| ABE8.6-d | | | | | | | | | | | | | | | | | | R |
| ABE8.7-d | | | | | | | | | | | | | | R | | | | |
| ABE8.8-d | | | | | | | | | | H | | R | | R | | | | |
| ABE8.9-d | | | | | Y | | | | | | | R | | R | | | | |
| ABE8.10-d | | | | | | | | | | | | R | | R | | | | R |
| ABE8.11-d | | | | | | | | | | | | T | | R | | | | |
| ABE8.12-d | | | | | | | | | | | | T | | S | | | | |
| ABE8.13-d | | | | | Y | | | | | H | | R | | R | | | | |
| ABE8.14-d | | | | | Y | S | | | | | | | | | | | | |
| ABE8.15-d | | | | | | S | | | | | | R | | | | | | |
| ABE8.16-d | | | | | | S | | | | H | | R | | | | | | |
| ABE8.17-d | | | | | | S | | | | | | | | R | | | | |
| ABE8.18-d | | | | | | S | | | | H | | | | R | | | | |
| ABE8.19-d | | | | | | S | | | | H | | R | | R | | | | |
| ABE8.20-d | | | | | Y | S | | | | H | | R | | R | | | | |
| ABE8.21-d | | | | | | | | | | | | R | | S | | | | |
| ABE8.22-d | | | | | | S | | | | | | | | S | | | | |
| ABE8.23-d | | | | | | S | | | | H | | | | | | | | |
| ABE8.24-d | | | | | | S | | | | H | | T | | | | | | |

In some embodiments, the base editor is ABE8.1, which comprises or consists essentially of the following sequence or a fragment thereof having adenosine deaminase activity:

ABE8.1_Y147T_CP5_NGC PAM_monomer
MSEVEFSHEYWMRHALTLAKRARDEREVPVGAVLVLNNRVIGEGWNRAIG

LHDPTAHAEIMALRQGGLVMQNYRIIDATLYVTFEPCVMCAGAMIHSRIG

RVVFGVRNAKTGAAGSLMDVLHYPGMNHRVEITEGILADECAALLCTFFR

MPRQVFNAQKKAQSSTD*SGGSSGGSSGSETPGTSESATPESSGGSSGGS*E

IGKATAKYFFYSNIMNFFKTEITLANGEIRKRPLIETNGETGEIVWDKGR

DFATVRKVLSMPQVNIVKKTEVQTGGFSKESILPKRNSDKLIARKKDWDP

KKYGGFMQPTVAYSVLVVAKVEKGKSKKLKSVKELLGITIMERSSFEKNP

IDFLEAKGYKEVKKDLIIKLPKYSLFELENGRKRMLASAKFLQKGNELAL

PSKYVNFLYLASHYEKLKGSPEDNEQKQLFVEQHKHYLDEIIEQISEFSK

RVILADANLDKVLSAYNKHRDKPIREQAENIIHLFTLTNLGAPRAFKYFD

TTIARKEYRSTKEVLDATLIHQSITGLYETRIDLSQLGGD*GGSGGSGGSG*

*GSGGSGGSGGM*DKKYSIGLAIGTNSVGWAVITDEYKVPSKKFKVLGNTDR

HSIKKNLIGALLFDSGETAEATRLKRTARRRYTRRKNRICYLQEIFSNEM

AKVDDSFFHRLEESFLVEEDKKHERHPIFGNIVDEVAYHEKYPTIYHLRK

KLVDSTDKADLRLIYLALAHMIKFRGHFLIEGDLNPDNSDVDKLFIQLVQ

TYNQLFEENPINASGVDAKAILSARLSKSRRLENLIAQLPGEKKNGLFGN

LIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNAS

LGTYHDLLKIIKDKDFLDNEENEDILEDIVLTLTLFEDREMIEERLKTYA

-continued

HLFDDKVMKQLKRRRYTGWGRLSRKLINGIRDKQSGKTILDFLKSDGFAN

RNEMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKE

LGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMN

TKYDENDKLIREVKVITLKSKLVSDFRKDFQFYKVREINNYHHAHDAYLN

AVVGTALIKKYPKLESEFVYGDYKVYDVRKMIAKSEQEGADKRTADGSEF

ESPKKKRKV*

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.1, which comprises or consists essentially of the following sequence or a fragment thereof having adenosine deaminase activity:

pNMG-B335 ABE8.1_Y147T_CP5_NGC PAM_monomer
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSTDSGGSS*GGSSGSETPGTSESATPESSGGSSGGS*E

IGKATAKYFFYSNIMNFFKTEITLANGEIRKRPLIETNGETGEIVWDKGR

DFATVRKVLSMPQVNIVKKTEVQTGGFSKESILPKRNSDKLIARKKDWDP

KKYGGFMQPTVAYSVLVVAKVEKGKSKKLKSVKELLGITIMERSSFEKNP

IDFLEAKGYKEVKKDLIIKLPKYSLFELENGRKRMLASAKFLQKGNELAL

PSKYVNFLYLASHYEKLKGSPEDNEQKQLFVEQHKHYLDEIIEQISEFSK

RVILADANLDKVLSAYNKHRDKPIREQAENIIHLFTLTNLGAPRAFKYFD

TTIARKEYRSTKEVLDATLIHQSITGLYETRIDLSQLGGD*GGSGGSGGSG*

-continued

*GSGGGSGGSGGM*DKKYSIGLAIGTNSVGWAVITDEYKVPSKKFKVLGNTDR

HSIKKNLIGALLFDSGETAEATRLKRTARRRYTRRKNRICYLQEIFSNEM

AKVDDSFFHRLEESFLVEEDKKHERHPIFGNIVDEVAYHEKYPTIYHLRK

KLVDSTDKADLRLIYLALAHMIKFRGHFLIEGDLNPDNSDVDKLFIQLVQ

TYNQLFEENPINASGVDAKAILSARLSKSRRLENLIAQLPGEKKNGLFGN

LIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNAS

LGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFAN

RNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKE

LGSQILKEHPVENTQLQNEKLYLYYLQNGRDMYVDQELDINRLSDYDVDH

IVPQSFLKDDSIDNKVLTRSDKSRGKSDNVPSEEVVKKMKNYWRQLLNAK

LITQRKFDNLTKAERGGLSELDKAGFIKRQLVETRQITKHVAQILDSRMN

TKYDENDKL1REVKVLTLKSKLVSDHRKDEQEYKVREINNYHHAHDAYLN

AVVGTALIKKYPKLESEFVYGDYKVYDVRKMIAKSEQEGADKRTADGSEF

ESPKKKRKV*

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.14, which comprises or consists essentially of the following sequence or a fragment thereof having adenosine deaminase activity:

pNMG-357_ABE8.14 with NGC PAM CPS
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTDGGSSGGS*SGSETPGTSESATPESSGGSSGGS*MS

EVEFSHEYWMRHALTLAKRARDEREVPVGAVLVLNNRVIGEGWNRAIGLH

DPTAHAEIMALRQGGLVMQNYRLIDATLYVTFEPCVMCAGAMIHSRIGRV

VFGVRNAKTGAAGSLMDVLHYPGMNHRVEITEGILADECAALLCTFFRMP

RQVFNAQKKAQSSTDSGGSSGGSSGSETPGTSESATPESSGGSSGGSEIG

KATAKYFFYSNIMNFFKTEITLANGEIRKRPLIETNGETGEIVWDKGRDF

ATVRKVLSMPQVNIVKKTEVQTGGESKESILPKRNSDKLIARKKDWDPKK

YGGFMQPTVAYSVLVVAKVEKGKSKKLKSVKELLGITIMERSSFEKNPID

FLEAKGYKEVKKDLIIKLPKYSLFELENGRKRMLASAKFLQKGNELALPS

-continued

KYVNFLYLASHYEKLKGSPEDNEQKQLFVEQHKHYLDEIIEQISEFSKRV

ILADANLDKVLSAYNKHRDKPIREQAENIIHLFTLTNLGAPRAFKYFDTT

IARKEYRSTKEVLDATLIHQSITGLYETRIDLSQLGGD*GGSGGSGGSGGS*

*GGSGGSGGM*DKKYSIGLAIGTNSVGWAVITDEYKVPSKKFKVLGNTDRHS

IKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKL

VDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLI

ALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQ

LPEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFI

EFMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLG

TYHDLLKIIKDKDFLDNEENEDILEDIVLTLTLFEDREMIEERLKTYAHL

FDDKVMKQLKRRRYTGWGRLSRKLINGIRDKOSGKTILDFLKSDGFANRN

FMQLIHDDSLTFKEDIQKAOVSGQGDSLHEHIANLAGSPATKKGILQTVK

VVDELVKVMGRHKPENIVIEMARENQTTQKGQKNSRERMKRIEEGIKELG

SQILKEHPVENTQLQNEKLYLYYLQNGRDMYVDQELDINRLSDYDVDHIV

PQSFLKDDSIDNKVLTRSDKNRGKSDNVPSEEVVKKMKNYWRQLLNAKLI

TQRKFDNLTKAERGGLSELDKAGFIKRQLVETRQITKHVAQILDSRMNTK

YDENDKLIREVKVITLKSKLVSDFRKDFQFYKVREINNYHHAHDAYLNAV

VGTALIKKYPKLESEFVYGDYKVYDVRKMIAKSEQEGADKRTADGSEFES

PKKKRKV*

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.8-m, which comprises or consists essentially of the following sequence or a fragment thereof having adenosine deaminase activity:

ABE8.8-m
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHHPGMNHRVEITEGILADECAALLCRFFR

MPRRVFNAQKKAQSSTD*SGGSSGGSSGSETPGTSESATPESSGGSSGGS*D

KKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPIN

-continued

ASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVE

NTQLQNEKLYLYYLONGRDMYVDQELDINRLSDYDVDHIVPQSFLKDDSI

DNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIRE

VKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITL

ANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYS

LFELENGRKRMLASAGELQKGNELALPSKYVNFLYLASHYEKLKGSPEDN

EQKQLFVEQHKHYLDEIIEQTSEFSKRVILADANLDKVLSAYNKHRDKPI

REQAENIIHLFTLTNLGAPAAFKYFDTTIDRKRYTSTKEVLDATLIHQSI

TGLYETRIDLSQLGGDEGADKRTADGSEFESPKKKRKV*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.8-d, which comprises or consists essentially of the following sequence or a fragment thereof having adenosine deaminase activity:

ABE8.8-d
MSEVEFSHEYWMRHALTLAKRAWDEREVPVGAVLVHNNRVIGEGWNRPIG

RHDPTAHAEIMALRQGGLVMQNYRIIDATLYVTLEPCVMCAGAMIHSRIG

RVVFGARDAKTGAAGSLMDVLHHPGMNHRVEITEGILADECAALLSDFFR

MRRQEIKAQKKAQSSTD*SGGSSGGSSGSETPGTSESATPESSGGSSGGSS*

EVEFSHEYWMRHALTLAKRARDEREVPVGAVLVLNNRVIGEGWNRAIGLH

DPTAHAEIMALRQGGLVMQNYRLIDATLYVTFEPCVMCAGAMIHSRIGRV

VFGVRNAKTGAAGSLMDVLHHPGMNHRVEITEGILADECAALLCRFFRMP

RRVFNAQKKAQSSTD*SGGSSGGSSGSETPGTSESATPESSGGSSGGS*DKK

YSIGLAIGTNSVGWAVITDEYKVPSKKFKVLGNTDRHSIKKNLIGALLFD

SGETAEATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSEEKNPIDFLEAKGYKEVKKDLIIKLPKYSLF

ELENGRKRMLASAGELQKGNELALPSKYVNELYLASHYEKLKGSPEDNEQ

KQLEVEQHKHYLDEIIEQISEESKRVILADANLDKVLSAYNKHRDKPIRE

QAENIIHLFTLTNLGAPAAFKYFDTTIDRKRYTSTKEVIDATLIHQSITG

LYETRIDLSQLGGDEGADKRTADGSEFESPKKKRKV*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.13-m, which comprises or consists essentially of the following sequence or a fragment thereof having adenosine deaminase activity:

ABE8.13-m
MSEVEFSHEYWMRHALTLAKRARDEREVPVGAVLVLNNRVIGEGWNRAIG

LHDPTAHAEIMALRQGGLVMQNYRLYDATLYVTFEPCVMCAGAMIHSRIG

RVVFGVRNAKTGAAGSLMDVLHHPGMNHRVEITEGILADECAALLCRFFR

MPRRVFNAQKKAQSSTD*SGGSSGGSSGSETPGTSESATPESSGGSSGGS*D

KKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLE

-continued

ESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIRE

VKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITL

ANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYS

LFELENGRKRMLASAGELQKGNELALPSKYVNFLYLASHYEKLKGSPEDN

EQKQLFVEQHKHYLDEIIEQISEFSKRVILADANLDKVLSAYNKHRDKPI

REQAENITHLFTLTNLGAPAAFKYEDTTTDRKRYTSTKEVLDATLIHQSI

TGLYETRIDLSQLGGDEGADKRTADGSEFESPKKKRKV*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.13-d, which comprises or consists essentially of the following sequence or a fragment thereof having adenosine deaminase activity:

ABE8.13-d
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD*SGGSSGGSSGSETPGTSESATPESSGGSSGGSS*

EVEFSHEYWMRHALTLAKRARDEREVPVGAVLVLNNRVIGEGWNRAIGLH

DPTAHAEIMALRQGGLVMQNYRLYDATLYVTFEPCVMCAGAMIHSRIGRV

VFGVRNAKTGAAGSLMDVLH̲H̲PGMNHRVEITEGILADECAALLC̲R̲FFRMP

-continued

R̲R̲VFNAQKKAQSSTD*SGGSSGGSSGSETPGTSESATPESSGGSSGGS*DKK

YSIGLA̲IGTNSVGWAVITDEYKVPSKKFKVLGNTDRHSIKKNLIGALLFD

SGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHALLRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQ

KQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITG

LYETRIDLSQLGGDEGADKRTADGSEFESPKKKRKV*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.17-m, which comprises or consists essentially of the following sequence or a fragment thereof having adenosine deaminase activity:

ABE8.17-m
MSEVEFSHEYWMRHALTLAKRARDEREVPVGAVLVLNNRVIGEGWNRAIG

LHDPTAHAEIMALRQGGLVMQNYRIIDATLYS̲TFEPCVMCAGAMIHSRIG

RVVFGVRNAKTGAAGSLMDVLHYPGMNHRVEITEGILADECAALLCYFFR

-continued

```
MPRRVFNAQKKAQSSTDSGGSSGGSSGSETPGTSESATPESSGGSSGGSD

KKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQ

RTFDNGSTPHQIHLGELHAILRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIRE

VKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITL

ANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYS

LFELENGRKRMLASAGELQKGNELALPSKYVNFLYLASHYEKLKGSPEDN

EQKQLFVEQHKHYLDEIIEQISEFSKRVILADANLDKVLSAYNKHRDKPI

REQAENITHLFTLTNLGAPAAFKYEDTTTDRKRYTSTKEVLDATLIHQSI

TGLYETRIDLSQLGGDEGADKRTADGSEFESPKKKRKV*
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.17-d, which comprises or consists essentially of the following sequence or a fragment thereof having adenosine deaminase activity:

```
ABE8.17-d
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTDSGGSSGGSSGSETPGTSESATPESSGGSSGGSS
```

-continued

```
EVEFSHEYWMRHALTLAKRARDEREVPVGAVLVLNNRVIGEGWNRAIGLH

DPTAHAEIMALRQGGLVMQNYRLIDATLYSTFEPCVMCAGAMIHSRIGRV

VFGVRNAKTGAAGSLMDVLHYPGMNHRVEITEGILADECAALLCYFFRMP

RRVFNAQKKAQSSTDSGGSSGGSSGSETPGTSESATPESSGGSSGGSDKK

YSIGLAIGTNSVGWAVITDEYKVPSKKFKVLGNTDRHSIKKNLIGALLFD

SGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINAS

GVDAKATLSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHALLRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQ

KQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITG

LYETRIDLSQLGGDEGADKRTADGSEFESPKKKRKV*
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.20-m, which comprises or consists essentially of the following sequence or a fragment thereof having adenosine deaminase activity:

```
ABE8.20-m
MSEVEFSHEYWMRHALTLAKRARDEREVPVGAVLVLNNRVIGEGWNRAIG

LHDPTAHAEIMALRQGGLVMQNYRLYDATLYSTFEPCVMCAGAMIHSRIG

RVVFGVRNAKTGAAGSLMDVLHHPGMNHRVEITEGILADECAALLCRFFR

MPRRVFNAQKKAQSSTDSGGSSGGSSGSETPGTSESATPESSGGSSGGSD

KKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIRE

VKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITL

ANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYS

LFELENGRKRMLASAGELQKGNELALPSKYVNFLYLASHYEKLKGSPEDN

EQKQLFVEQHKHYLDEIIEQISEFSKRVILADANLDKVLSAYNKHRDKPI

REQAENITHLFTLTNLGAPAAFKYEDTTTDRKRYTSTKEVLDATLIHQSI

TGLYETRIDLSQLGGDEGADKRTADGSEFESPKKKRKV*
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.20-d, which comprises or consists essentially of the following sequence or a fragment thereof having adenosine deaminase activity:

```
ABE8.20-d
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTDSGGSSGGSSGSETPGTSESATPESSGGSSGGSS

EVEFSHEYWMRHALTLAKRARDEREVPVGAVLVLNNRVIGEGWNRAIGLH

DPTAHAEIMALRQGGLVMQNYRLYDATLYSTFEPCVMCAGAMIHSRIGRV

VFGVRNAKTGAAGSLMDVLHHPGMNHRVEITEGILADECAALLCRFFRMP

RRVFNAQKKAQSSTDSGGSSGGSSGSETPGTSESATPESSGGSSGGSDKK

YSIGLAIGTNSVGWAVITDEYKVPSKKFKVLGNTDRHSIKKNLIGALLFD

SGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPTNAS

GVDAKATLSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQ

KQLEVEQHKHYLDEIIEQISEFSKRVILADANLDKVLSAYNKHRDKPIRE

QAENIIHLFTLTNLGAPAAFKYFDTTIDRKRYTSTKEVLDATLIHQSITG

LYETRIDLSQLGGDEGADKRTADGSEFESPKKKRKV*
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, an ABE8 of the invention is selected from the following sequences:

01. monoABE8.1_bpNLS + Y147T
MSEVEFSHEYWMRHALTLAKRARDEREVPVGAVLVLNNRVIGEGWNRAIGLHDPTAHAEIMALR

QGGLVMQNYRI1DATLYVTFEPCVMCAGAMIHSRIGRVVFGVRNAKTGAAGSLMDVLHYPGMNH

RVEITEGILADECAALLCTFFRMPRQVFNAQKKAQSSTDSGGSSGGSSGSETPGTSESATPESS

GGSSGGSDKKYSIGLAIGTNSVGWAVITDEYKVPSKKFKVLGNTDRHSTKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQTGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSTPHQIHLGELHAILRRQEDFYPFLKDNREKIEK

ILTFRIPYYVGPLARGNSRFAWMTRKSEETITPWNFEEVVDKGASAQSFIERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGTKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVQTGGFSKESILPKRNSDKLIARKKDWDPKKYGGFVSPTVAYSVLVV

AKVEKGKSKKLKSVKELLGITIMERSSFEKNPIDFLEAKGYKEVKKDLIIKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENITHLFTLTNLGAPAAFKYFDTTIDRKQYRS

TKEVLDATLIHQSITGLYETRIDLSQLGGDEGADKRTADGSEFESPKKKRKV 02. monoABE8.1_bpNLS + Y147R
MSEVEFSHEYWMRHALTLAKRARDEREVPVGAVLVLNNRVIGEGWNRAIGLHDPTAHAEIMALR

QGGLVMQNYRLIDATLYVTFEPCVMCAGAMIHSRIGRVVFGVRNAKTGAAGSLMDVLHYPGMNH

RVEITEGILADECAALLCRFFRMPRQVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFTERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

-continued

```
RLKTYAHLFDDKVMKQLKRRRYTGWGRLSRKLTNGTRDKOSGKTJLDFTKSDGFANRNFMOTTH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLIIKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV
```

03. monoABE8.1_bpNLS + Q154S
```
MSEVEFSHEYWMRHALTLAKRARDEREVPVGAVLVLNNRVIGEGWNRAIGLHDPTAHAEIMALR

QGGLVMQNYRLIDATLYVTFEPCVMCAGAMIHSRIGRVVFGVRNAKTGAAGSLMDVLHYPGMNH

RVEITEGILADECAALLCYFFRMPRSVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFIERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV
```

04. monoABE8.1_bpNLS + Y123H
```
MSEVEFSHEYWMRHALTLAKRARDEREVPVGAVLVLNNRVIGEGWNRAIGLHDPTAHAEIMALR

QGGLVMQNYRIIDATLYVTFEPCVMCAGAMIHSRIGRVVFGVRNAKTGAAGSLMDVLHHPGMNH

RVEITEGILADECAALLCYFFRMPRQVFNAQKKAQSSTDSGGSSGGSSGSETPGTSESATPESS
```

-continued

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

TLTFRIPYYVGPLARGNSRFAWMTRKSEETITPWNFEEVVDKGASAQSFTERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLONGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV 05. monoABE8.1_bpNLS + V82S
MSEVEFSHEYWMRHALTLAKRARDEREVPVGAVLVLNNRVIGEGWNRAIGLHDPTAHAEIMALR

QGGLVMQNYRLIDATLYSTFEPCVMCAGAMIHSRIGRVVFGVRNAKTGAAGSLMDVLHYPGMNH

RVEITEGILADECAALLCYFFRMPRQVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFIERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFTKRQLVETRQITKHVAQTLDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV 06. monoABE8.1_bpNLS + T166R
MSEVEFSHEYWMRHALTLAKRARDEREVPVGAVLVLNNRVIGEGWNRAIGLHDPTAHAEIMALR

QGGLVMQNYRLIDATLYVTFEPCVMCAGAMIHSRIGRVVFGVRNAKTGAAGSLMDVLHYPGMNH

RVEITEGILADECAALLCYFFRMPRQVFNAQKKAQSSRDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFTERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLONGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENITHLFTLTNLGAPAAFKYFDTTIDRKQYRS

TKEVLDATLIHQSITGLYETRIDLSQLGGDEGADKRTADGSEFESPKKKRKV 07. monoABE8.1bpNLS + Q154R
MSEVEFSHEYWMRHALTLAKRARDEREVPVGAVLVLNNRVIGEGWNRAIGLHDPTAHAEIMALR

QGGLVMQNYRLIDATLYVTFEPCVMCAGAMIHSRIGRVVFGVRNAKTGAAGSLMDVLHYPGMNH

RVEITEGILADECAALLCYFFRMPRRVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

-continued

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFTERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLTNGTRDKOSGKTJLDFTKSDGFANRNFMOTTH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV 08. monoABE8.1_bpNLS + Y147R_Q154R_Y123H
MSEVEFSHEYWMRHALTLAKRARDEREVPVGAVLVLNNRVIGEGWNRAIGLHDPTAHAEIMALR

QGGLVMQNYRLIDATLYVTFEPCVMCAGAMIHSRIGRVVFGVRNAKTGAAGSLMDVLHHPGMNH

RVEITEGILADECAALLCRFFRMPRRVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFIERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLONGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

-continued

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV 09. monoABE8.1_bpNLS + Y147R_Q154R_I76Y
MSEVEFSHEYWMRHALTLAKRARDEREVPVGAVLVLNNRVIGEGWNRAIGLHDPTAHAEIMALR

QGGLVMQNYRLYDATLYVTFEPCVMCAGAMIHSRIGRVVFGVRNAKTGAAGSLMDVLHYPGMNH

RVEITEGILADECAALLCRFFRMPRRVFNAQKKAQSSTDSGGSSGGSSGSETPGTSESATPESS

GGSSGGSSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

TLTFRIPYYVGPLARGNSRFAWMTRKSEETITPWNFEEVVDKGASAQSFTERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV 10. monoABE8.1_bpNLS + Y147R_Q154R_T166R
MSEVEFSHEYWMRHALTLAKRARDEREVPVGAVLVLNNRVIGEGWNRAIGLHDPTAHAEIMALR

QGGLVMQNYRLIDATLYVTFEPCVMCAGAMIHSRIGRVVFGVRNAKTGAAGSLMDVLHYPGMNH

RVEITEGILADECAALLCRFFRMPRRVFNAQKKAQSSRDSGGSSGGSSGSETPGTSESATPESS

GGSSGGSSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFIERMTNFDKNLPNEK

VLPKHSLLYEYFTVYNELTKVKYVTEGMRKPAFLSGEQKKAIVDLLFKTNRKVTVKQLKEDYFK

-continued

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFTKRQLVETRQITKHVAQTLDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV 11. monoABE8.1_bpNLS + Y147T_Q151R
MSEVEFSHEYWMRHALTLAKRARDEREVPVGAVLVLNNRVIGEGWNRAIGLHDPTAHAEIMALR

QGGLVMQNYRLIDATLYVTFEPCVMCAGAMIHSRIGRVVFGVRNAKTGAAGSLMDVLHYPGMNH

RVEITEGILADECAALLCTFFRMPRRVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFTERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENITHLFTLTNLGAPAAFKYFDTTIDRKQYRS

TKEVLDATLIHQSITGLYETRIDLSQLGGDEGADKRTADGSEFESPKKKRKV

-continued 12. monoABE8.1_bpNLS + Y147T_Q154S
MSEVEFSHEYWMRHALTLAKRARDEREVPVGAVLVLNNRVIGEGWNRAIGLHDPTAHAEIMALR

QGGLVMQNYRLIDATLYVTFEPCVMCAGAMIHSRIGRVVFGVRNAKTGAAGSLMDVLHYPGMNH

RVEITEGILADECAALLCTFFRMPRSVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFTERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLTNGTRDKOSGKTJLDFTKSDGFANRNFMOTTH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV 13. monoABE8.1_bpNLS + H123Y123H_Y147R_Q154R_I76Y
MSEVEFSHEYWMRHALTLAKRARDEREVPVGAVLVLNNRVIGEGWNRAIGLHDPTAHAEIMALR

QGGLVMQNYRLYDATLYVTFEPCVMCAGAMIHSRIGRVVFGVRNAKTGAAGSLMDVLHHPGMNH

RVEITEGILADECAALLCRFFRMPRRVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFIERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

-continued

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVOTGGFSKESILPKRNSDKLIARKKDWDPKKYGGFVSPTVAYSVLVV

AKVEKGKSKKLKSVKELLGITIMERSSEEKNPLDFLEAKGYKEVKKDLLLKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRKV 14. monoABE8.1_bpNLS + V82S + Q154R
MSEVEFSHEYWMRHALTLAKRARDEREVPVGAVLVLNNRVIGEGWNRAIGLHDPTAHAEIMALR

QGGLVMQNYRIIDATLYSTFEPCVMCAGAMIHSRIGRVVFGVRNAKTGAAGSLMDVLHYPGMNH

RVEITEGILADECAALLCYFFRMPRRVFNAQKKAQSSTDSGGSSGGSSGSETPGTSESATPESS

GGSSGGSDKKYSIGLAIGTNSVGWAVITDEYKVPSKKFKVLGNTDRHSIKKNLIGALLFDSGET

AEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQEEFYKFIKP

ILEKMDGTEELLVKLNREDLLRKQRTFDNGSIPHQIHLGELHAILRRQEDFYPFLKDNREKIEK

TLTFRIPYYVGPLARGNSRFAWMTRKSEETITPWNFEEVVDKGASAQSFTERMTNFDKNLPNEK

VLPKHSLLYEYFTVYNELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDIVLTLTLFEDREMIEE

RLKTYAHLFDDKVMKQLKRRRYTGWGRLSRKLINGIRDKQSGKTILDFLKSDGFANRNFMQLIH

DDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVK

VITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFAT

VRKVLSMPQVNIVKKTEVQTGGFSKESILPKRNSDKLIARKKDWDPKKYGGFVSPTVAYSVLVV

AKVEKGKSKKLKSVKELLGITIMERSSFEKNPIDFLEAKGYKEVKKDLIIKLPKYSLFELENGR

KRMLASARELQKGNELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFKYFDTTIDRKQYRS

TKEVLDATLIHQSITGLYETRIDLSQLGGDEGADKRTADGSEFESPKKKRRV

In some embodiments, the base editor is a ninth generation ABE (ABE9). In some embodiments, the ABE9 contains a TadA*9 variant. ABE9 base editors include an adenosine deaminase variant comprising an amino acid sequence, which contains alterations relative to an ABE 7*10 reference sequence, as described herein. The term "monomer" as used in Table 19 refers to a monomeric form of TadA*7.10 comprising the alterations described in Table 19. The term "heterodimer" as used in Table 19 refers to the specified wild-type E. coli TadA adenosine deaminase fused to a TadA*7.10 comprising the alterations described in Table 19 as described herein. Details of ABE9 base editors are described in International PCT Application No. PCT/2020/049975, which is incorporated herein by reference for its entirety.

TABLE 17

Adenosine Deaminase Base Editor 9 (ABE9) Variants

| ABE9 Description | Alterations |
|---|---|
| ABE9.1__monomer | E25F, V82S, Y123H, T133K, Y147R, Q154R |
| ABE9.2__monomer | E25F, V82S, Y123H, Y147R, Q154R |
| ABE9.3 __monomer | V82S, Y123H, P124W, Y147R, Q154R |
| ABE9.4__monomer | L51W, V82S, Y123H, C146.R, Y147R, Q154R |
| ABE9.5__monomer | P54C, V82S, Y123H, Y147R, Q154R |
| ABE9.6__monomer | Y73S, V82S, Y123H, Y147R, Q154R |
| ABE9.7__monomer | N38G, V82T, Y123H, Y147R, Q154R |
| ABE9.8__monomer | R23H, V82S, Y123H, Y147R, Q154R |
| ABE9.9__monomer | R21N, V82S, Y123H, Y147R, Q154R |
| ABE9.10__monomer | V82S, Y123H, Y147R, Q154R, A158K |
| ABE9.11__monomer | N72K, V82S, Y123H, D139L, Y147R, Q154R, |
| ABE9.12__monomer | E25F, V82S, Y123H, D139M, Y147R, Q154R |
| ABE9.13 monomer | M70V. V82S, M94V, Y123H, Y147R, Q154R |
| ABE9.14__monomer | Q71M, V82S, Y123H, Y147R, Q154R |
| ABE9.15__heterodimer | E25F, V82S, Y123H, T133K, Y147R, Q154R |
| ABE9.16__heterodimer | E25F, V82S, Y123H, Y147R, Q154R |
| ABE9.17__heterodimer | V82S, Y123H, P124W, Y147R, Q154R |
| ABE9.18__heterodimer | L51W, V82S, Y123H, C146R, Y147R, Q154R |
| ABE9.19__heterodimer | P54C, V82S, Y123H, Y147R, Q154R |
| ABE9.2 __heterodimer | Y73S, V82S, Y123H, Y147R, Q154R |
| ABE9.21__heterodimer | N38G, V82T, Y123H, Y147R, Q154R |
| ABE9.22__heterodimer | R23H, V82S, Y123H, Y147R, Q154R |
| ABE9.23__heterodimer | R21N, V82S, Y123H, Y147R, Q154R |
| ABE9.24__heterodimer | V82S, Y123H, Y147R, Q154R, A158K |
| ABE9.25__heterodimer | N72K, V82S, Y123H, D139L, Y147R, Q154R, |
| ABE9.26__heterodimer | E25F, V82S, Y123H, D139M, Y147R, Q154R |
| ABE9.27__heterodimer | M70V, V82S, M94V, Y123H, Y147R, Q154R |
| ABE9.28__heterodimer | Q71M, V82S, Y123H, Y147R, Q154R |
| ABE9.29__monomer | E25F_I76Y_V82S_Y123H_Y147R_Q154R |
| ABE9.30__monomer | I76Y_V82T_Y123H_Y147R_Q154R |
| ABE9.31__monomer | N38G_I76Y_V82S_Y123H_Y147R_Q154R |
| ABE9.32__monomer | N38G_I76Y_V82T_Y123H_Y147R_Q154R |
| ABE9.33__monomer | R23H_I76Y_V82S_Y123H_Y147R_Q154R |
| ABE9.34__monomer | P54C_I76Y_V82S_Y123H_Y147R_Q154R |
| ABE9.35__monomer | R21N_I76Y_V82S_Y123H_Y147R_Q154R |
| ABE9.36__monomer | I76Y_V82S_Y123H_D138M_Y147R_Q154R |
| ABE9.37__monomer | Y72S_I76Y_V82S_Y123H_Y147R_Q154R |
| ABE9.38__heterodimer | E25F_I76Y_V82S_Y123H_Y147R_Q154R |
| ABE9.39__heterodimer | I76Y_V82T_Y123H_Y147R_Q154R |
| ABE9.40__heterodimer | N38G_I76Y_V82S_Y123H_Y147R_Q154R |
| ABE9.41__heterodimer | N38G_I76Y_V82T_Y123H_Y147R_Q154R |
| ABE9.42__heterodimer | R23H_I76Y_V82S_Y123H_Y147R_Q154R |
| ABE9.43__heterodimer | P54C_I76Y_V82S_Y123H_Y147R_Q154R |
| ABE9.44__heterodimer | R21N_I76Y_V82S_Y123H_Y147R_Q154R |
| ABE9.45__heterodimer | I76Y_V82S_Y123H_D138M_Y147R_Q154R |
| ABE9.46__heterodimer | Y72S_I76Y_V82S_Y123H_Y147R_Q154R |
| ABE9.47__monomer | N72K_V82S, Y123H, Y147R, Q154R |
| ABE9.48__monomer | Q71M_V82S, Y123H, Y147R, Q154R |
| ABE9.49__monomer | M70V, V82S, M94V, Y123H, Y147R, Q154R |
| ABE9.50__monomer | V82S, Y123H, T133K, Y147R, Q154R |
| ABE9.51__monomer | V82S, Y123H, T133K, Y147R, Q154R, A158K |
| ABE9.52__monomer | M70V, Q71M, N72K, V82S, Y123H, Y147R, Q154R |
| ABE9.53__heterodimer | N72K_V82S, Y123H, Y147R, Q154R |
| ABE9.54__heterodimer | Q71M_V82S, Y123H, Y147R, Q154R |

TABLE 17-continued

Adenosine Deaminase Base Editor 9 (ABE9) Variants

| ABE9 Description | Alterations |
|---|---|
| ABE9.55__heterodimer | M70V, V82S, M94V, Y123H, Y147R, Q154R |
| ABE9.56__heterodimer | V82S, Y123H, T133K, Y147R, Q154R |
| ABE9.57__heterodimer | V82S, Y123H, T133K, Y147R, Q154R, A158K |
| ABE9.58__heterodimer | M70V, Q71M, N72K, V82S, Y123H, Y147R, Q154R |

In some embodiments, the base editor is a fusion protein comprising a polynucleotide programmable nucleotide binding domain (e.g., Cas9-derived domain) fused to a nucleobase editing domain (e.g., all or a portion of a deaminase domain). In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the base editor further comprises a domain comprising all or a portion of a uracil glycosylase inhibitor (UGI). In some embodiments, the base editor comprises a domain comprising all or a portion of a uracil binding protein (UBP), such as a uracil DNA glycosylase (UDG). In some embodiments, the base editor comprises a domain comprising all or a portion of a nucleic acid polymerase. In some embodiments, a base editor can comprise as a domain all or a portion of a nucleic acid polymerase (NAP). For example, a base editor can comprise all or a portion of a eukaryotic NAP. In some embodiments, a NAP or portion thereof incorporated into a base editor is a DNA polymerase. In some embodiments, a NAP or portion thereof incorporated into a base editor has translesion polymerase activity. In some embodiments, a NAP or portion thereof incorporated into a base editor is a translesion DNA polymerase. In some embodiments, a NAP or portion thereof incorporated into a base editor is a Rev7, Rev1 complex, polymerase iota, polymerase kappa, or polymerase eta. In some embodiments, a NAP or portion thereof incorporated into a base editor is a eukaryotic polymerase alpha, beta, gamma, delta, epsilon, gamma, eta, iota, kappa, lambda, mu, or nu component. In some embodiments, a NAP or portion thereof incorporated into a base editor comprises an amino acid sequence that is at least 75%, 80%, 85%, 90%, 95%, 96%, 97%, 98%, 99%, or 99.5% identical to a nucleic acid polymerase (e.g., a translesion DNA polymerase). In some embodiments, a nucleic acid polymerase or portion thereof incorporated into a base editor is a translesion DNA polymerase.

In some embodiments, a domain of the base editor can comprise multiple domains. For example, the base editor comprising a polynucleotide programmable nucleotide binding domain derived from Cas9 can comprise an REC lobe and an NUC lobe corresponding to the REC lobe and NUC lobe of a wild-type or natural Cas9. In another example, the base editor can comprise one or more of a RuvCI domain, BH domain, REC1 domain, REC2 domain, RuvCII domain, L1 domain, HNH domain, L2 domain, RuvCIII domain, WED domain, TOPO domain or CTD domain. In some embodiments, one or more domains of the base editor comprise a mutation (e.g., substitution, insertion, deletion)

relative to a wild-type version of a polypeptide comprising the domain. For example, an HNH domain of a polynucleotide programmable DNA binding domain can comprise an H840A substitution. In another example, a RuvCI domain of a polynucleotide programmable DNA binding domain can comprise a D10A substitution.

Different domains (e.g., adjacent domains) of the base editor disclosed herein can be connected to each other with or without the use of one or more linker domains (e.g., an XTEN linker domain). In some embodiments, a linker domain can be a bond (e.g., covalent bond), chemical group, or a molecule linking two molecules or moieties, e.g., two domains of a fusion protein, such as, for example, a first domain (e.g., Cas9-derived domain) and a second domain (e.g., an adenosine deaminase domain or a cytidine deaminase domain). In some embodiments, a linker is a covalent bond (e.g., a carbon-carbon bond, disulfide bond, carbon-hetero atom bond, etc.). In certain embodiments, a linker is a carbon nitrogen bond of an amide linkage. In certain embodiments, a linker is a cyclic or acyclic, substituted or unsubstituted, branched or unbranched aliphatic or heteroaliphatic linker. In certain embodiments, a linker is polymeric (e.g., polyethylene, polyethylene glycol, polyamide, polyester, etc.). In certain embodiments, a linker comprises a monomer, dimer, or polymer of aminoalkanoic acid. In some embodiments, a linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, a linker comprises a monomer, dimer, or polymer of aminohexanoic acid (Ahx). In certain embodiments, a linker is based on a carbocyclic moiety (e.g., cyclopentane, cyclohexane). In other embodiments, a linker comprises a polyethylene glycol moiety (PEG). In certain embodiments, a linker comprises an aryl or heteroaryl moiety. In certain embodiments, the linker is based on a phenyl ring. A linker can include functionalized moieties to facilitate attachment of a nucleophile (e.g., thiol, amino) from the peptide to the linker. Any electrophile can be used as part of the linker. Exemplary electrophiles include, but are not limited to, activated esters, activated amides, Michael acceptors, alkyl halides, aryl halides, acyl halides, and isothiocyanates. In some embodiments, a linker joins a gRNA binding domain of an RNA-programmable nuclease, including a Cas9 nuclease domain, and the catalytic domain of a nucleic acid editing protein. In some embodiments, a linker joins a dCas9 and a second domain (e.g. UGI, etc.).

Linkers

In certain embodiments, linkers may be used to link any of the peptides or peptide domains of the invention. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.).

In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

Typically, a linker is positioned between, or flanked by, two groups, molecules, or other moieties and connected to each one via a covalent bond, thus connecting the two. In some embodiments, a linker is an amino acid or a plurality of amino acids (e.g., a peptide or protein). In some embodiments, a linker is an organic molecule, group, polymer, or chemical moiety. In some embodiments, a linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length. Longer or shorter linkers are also contemplated.

In some embodiments, any of the fusion proteins provided herein, comprise a cytidine or adenosine deaminase and a Cas9 domain that are fused to each other via a linker. Various linker lengths and flexibilities between the cytidine or adenosine deaminase and the Cas9 domain can be employed (e.g., ranging from very flexible linkers of the form $(GGGS)_n$ (SEQ ID NO: 1308), $(GGGGS)_n$ (SEQ ID NO: 109), and $(G)_n$ to more rigid linkers of the form $(EAAAK)_n$ (SEQ ID NO: 1309), $(SGGS)_n$ (SEQ ID NO: 57), SGSETPGTSESATPES (SEQ ID NO: 56) (see, e.g., Guilinger J P, et al. Fusion of catalytically inactive Cas9 to FokI nuclease improves the specificity of genome modification. Nat. Biotechnol. 2014; 32(6): 577-82; the entire contents are incorporated herein by reference) and $(XP_n)$ in order to achieve the optimal length for activity for the cytidine or adenosine deaminase nucleobase editor. In some embodiments, n is 1, 2, 3, 4, 5, 6, 7, 8, 9, 10, 11, 12, 13, 14, or 15. In some embodiments, the linker comprises a $(GGS)_n$ motif, wherein n is 1, 3, or 7 (SEQ ID NO: 1450). In some embodiments, cytidine deaminase or adenosine deaminase and the Cas9 domain of any of the fusion proteins provided herein are fused via a linker comprising the amino acid sequence SGSETPGTSESATPES (SEQ ID NO: 56), which can also be referred to as the XTEN linker. In some embodiments, a linker comprises a plurality of proline residues and is 5-21, 5-14, 5-9, 5-7 amino acids in length, e.g., PAPAP (SEQ ID NO: 65), PAPAPA (SEQ ID NO: 66), PAPAPAP (SEQ ID NO: 67), PAPAPAPA (SEQ ID NO: 68), $P(AP)_4$ (SEQ ID NO: 69), $P(AP)_7$ (SEQ ID NO: 70), $P(AP)_{10}$ (SEQ ID NO: 71) (see, e.g., Tan J, Zhang F, Karcher D, Bock R. Engineering of high-precision base editors for site-specific single nucleotide replacement. Nat Commun.

2019 Jan. 25; 10(1):439; the entire contents are incorporated herein by reference). Such proline-rich linkers are also termed "rigid" linkers.

In another embodiment, the base editor system comprises a component (protein) that interacts non-covalently with a deaminase (DNA deaminase), e.g., an adenosine or a cytidine deaminase, and transiently attracts the adenosine or cytidine deaminase to the target nucleobase in a target polynucleotide sequence for specific editing, with minimal or reduced bystander or target-adjacent effects. Such a non-covalent system and method involving deaminase-interacting proteins serves to attract a DNA deaminase to a particular genomic target nucleobase and decouples the events of on-target and target-adjacent editing, thus enhancing the achievement of more precise single base substitution mutations. In an embodiment, the deaminase-interacting protein binds to the deaminase (e.g., adenosine deaminase or cytidine deaminase) without blocking or interfering with the active (catalytic) site of the deaminase from engaging the target nucleobase (e.g., adenosine or cytidine, respectively). Such as system, termed "MagnEdit," involves interacting proteins tethered to a Cas9 and gRNA complex and can attract a co-expressed adenosine or cytidine deaminase (either exogenous or endogenous) to edit a specific genomic target site, and is described in McCann, J. et al., 2020, "MagnEdit—interacting factors that recruit DNA-editing enzymes to single base targets," Life-Science-Alliance, Vol. 3, No. 4 (e201900606), (doi 10.26508/Isa.201900606), the contents of which are incorporated by reference herein in their entirety. In an embodiment, the DNA deaminase is an adenosine deaminase variant (e.g., TadA*8) as described herein.

In another embodiment, a system called "Suntag," involves non-covalently interacting components used for recruiting protein (e.g., adenosine deaminase or cytidine deaminase) components, or multiple copies thereof, of base editors to polynucleotide target sites to achieve base editing at the site with reduced adjacent target editing, for example, as described in Tanenbaum, M. E. et al., "A protein tagging system for signal amplification in gene expression and fluorescence imaging," *Cell.* 2014 October 23; 159(3): 635-646. doi:10.1016/j.cell.2014.09.039; and in Huang, Y.-H. et al., 2017, "DNA epigenome editing using CRISPR-Cas SunTag-directed DNMT3A," Genome Biol 18: 176. doi: 10.1186/s13059-017-1306-z, the contents of each of which are incorporated by reference herein in their entirety. In an embodiment, the DNA deaminase is an adenosine deaminase variant (e.g., TadA*8) as described herein.

Nucleic Acid Programmable DNA Binding Proteins with Guide RNAs

Provided herein are compositions and methods for base editing in host cells, e.g. immune cells (e.g., T- or NK-cells). Further provided herein are compositions comprising a guide polynucleic acid sequence, e.g. a guide RNA sequence, or a combination of 2, 3, 4, 5, 6, 7, 8, 9, 10, 11, 12, 13, 14, 15, 16, 17, 18, 19, 20, or more guide RNAs as provided herein. In some embodiments, a composition for base editing as provided herein further comprises a polynucleotide that encodes a base editor, e.g. a C-base editor or an A-base editor. For example, a composition for base editing may comprise a mRNA sequence encoding a BE, a BE4, an ABE, and a combination of one or more guide RNAs as provided. A composition for base editing may comprise a base editor polypeptide and a combination of one or more of any guide RNAs provided herein. Such a composition may be used to effect base editing in an immune cell through different delivery approaches, for example, electroporation, nucleofection, viral transduction or transfection. In some embodiments, the composition for base editing comprises an mRNA sequence that encodes a base editor and a combination of one or more guide RNA sequences provided herein for electroporation.

Some aspects of this disclosure provide complexes comprising any of the fusion proteins provided herein, and a guide RNA bound to a nucleic acid programmable DNA binding protein (napDNAbp) domain (e.g., a Cas9 (e.g., a dCas9, a nuclease active Cas9, or a Cas9 nickase) or Cas12) of the fusion protein. These complexes are also termed ribonucleoproteins (RNPs). In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is an RNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 5 or 5'-NAA-3'). In some embodiments, the guide nucleic acid (e.g., guide RNA) is complementary to a sequence in a gene of interest (e.g., a gene associated with a disease or disorder).

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence. In some embodiments, the 3' end of the target sequence is immediately adjacent to an e.g., TTN, DTTN, GTTN, ATTN, ATTC, DTTNT, WTTN, HATY, TTTN, TTTV, TTTC, TG, RTR, or YTN PAM site.

It will be understood that the numbering of the specific positions or residues in the respective sequences depends on the particular protein and numbering scheme used. Numbering might differ, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for napDNAbp (e.g., Cas9 or Cas12) binding, and a guide sequence, which confers sequence specificity to the napDNAbp:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting napDNAbp:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Distinct portions of sgRNA are predicted to form various features that interact with Cas9 (e.g., SpyCas9) and/or the DNA target. Six conserved modules have been identified within native crRNA:tracrRNA duplexes and single guide RNAs (sgRNAs) that direct Cas9 endonuclease activity (see Briner et al., Guide RNA Functional Modules Direct Cas9 Activity and Orthogonality Mol Cell. 2014 Oct. 23; 56(2): 333-339). The six modules include the spacer responsible for DNA targeting, the upper stem, bulge, lower stem formed by the CRISPR repeat:tracrRNA duplex, the nexus, and hairpins from the 3' end of the tracrRNA. The upper and lower stems interact with Cas9 mainly through sequence-independent interactions with the phosphate backbone. In some embodiments, the upper stem is dispensable. In some embodiments, the conserved uracil nucleotide sequence at the base of the lower stem is dispensable. The bulge participates in specific side-chain interactions with the Rec domain of Cas9. The nucleobase of U44 interacts with the side chains of Tyr 325 and His 328, while G43 interacts with Tyr 329. The nexus forms the core of the sgRNA:Cas9 interactions and lies at the intersection between the sgRNA and both Cas9 and the target DNA. The nucleobases of A51 and A52 interact with the side chain of Phe 1105; U56 interacts with Arg 457 and Asn 459; the nucleobase of U59 inserts into a hydrophobic pocket defined by side chains of Arg 74, Asn 77, Pro 475, Leu 455, Phe 446, and Ile 448; C60 interacts with Leu 455, Ala 456, and Asn 459, and C61 interacts with the side chain of Arg 70, which in turn interacts with C15. In some embodiments, one or more of these mutations are made in the bulge and/or the nexus of a sgRNA for a Cas9 (e.g., spyCas9) to optimize sgRNA:Cas9 interactions.

Moreover, the tracrRNA nexus and hairpins are critical for Cas9 pairing and can be swapped to cross orthogonality barriers separating disparate Cas9 proteins, which is instrumental for further harnessing of orthogonal Cas9 proteins. In some embodiments, the nexus and hairpins are swapped to target orthogonal Cas9 proteins. In some embodiments, a sgRNA is dispensed of the upper stem, hairpin 1, and/or the sequence flexibility of the lower stem to design a guide RNA that is more compact and conformationally stable. In some embodiments, the modules are modified to optimize multiplex editing using a single Cas9 with various chimeric guides or by concurrently using orthogonal systems with different combinations of chimeric sgRNAs. Details regarding guide functional modules and methods thereof are described, for example, in Briner et al., Guide RNA Functional Modules Direct Cas9 Activity and Orthogonality Mol Cell. 2014 Oct. 23; 56(2):333-339, the contents of which is incorporated by reference herein in its entirety.

The domains of the base editor disclosed herein can be arranged in any order. Non-limiting examples of a base editor comprising a fusion protein comprising e.g., a polynucleotide-programmable nucleotide-binding domain (e.g., Cas9 or Cas12) and a deaminase domain (e.g., cytidine or adenosine deaminase) can be arranged as follows:

$NH_2$-[nucleobase editing domain]-Linker1-[nucleobase editing domain]-COOH;

$NH_2$-[deaminase]-Linker1-[nucleobase editing domain]-COOH;

$NH_2$-[deaminase]-Linker1-[nucleobase editing domain]-Linker2-[UGI]-COOH;

$NH_2$-[deaminase]-Linker1-[nucleobase editing domain]-COOH;

$NH_2$-[adenosine deaminase]-Linker1-[nucleobase editing domain]-COOH;

$NH_2$-[nucleobase editing domain]-[deaminase]-COOH;

$NH_2$-[deaminase]-[nucleobase editing domain]-[inosine BER inhibitor]-COOH;

$NH_2$-[deaminase]-[inosine BER inhibitor]-[nucleobase editing domain]-COOH;

$NH_2$-[inosine BER inhibitor]-[deaminase]-[nucleobase editing domain]-COOH;

$NH_2$-[nucleobase editing domain]-[deaminase]-[inosine BER inhibitor]-COOH;

$NH_2$-[nucleobase editing domain]-[inosine BER inhibitor]-[deaminase]-COOH;

$NH_2$-[inosine BER inhibitor]-[nucleobase editing domain]-[deaminase]-COOH;

NH2-[nucleobase editing domain]-Linker1-[deaminase]-Linker2-[nucleobase editing domain]-COOH;

NH2-[nucleobase editing domain]-Linker1-[deaminase]-[nucleobase editing domain]-COOH;

NH2-[nucleobase editing domain]-[deaminase]-Linker2-[nucleobase editing domain]-COOH;

NH2-[nucleobase editing domain]-[deaminase]-[nucleobase editing domain]-COOH;

NH2-[nucleobase editing domain]-Linker1-[deaminase]-Linker2-[nucleobase editing domain]-[inosine BER inhibitor]-COOH;

NH2-[nucleobase editing domain]-Linker1-[deaminase]-[nucleobase editing domain]-[inosine BER inhibitor]-COOH;

NH2-[nucleobase editing domain]-[deaminase]-Linker2-[nucleobase editing domain]-[inosine BER inhibitor]-COOH;

NH2-[nucleobase editing domain]-[deaminase]-[nucleobase editing domain]-[inosine BER inhibitor]-COOH;

NH2-[inosine BER inhibitor]-[nucleobase editing domain]-Linker1-[deaminase]-Linker2-[nucleobase editing domain]-COOH;

NH2-[inosine BER inhibitor]-[nucleobase editing domain]-Linker1-[deaminase]-[nucleobase editing domain]-COOH;

NH2-[inosine BER inhibitor]-[nucleobase editing domain]-[deaminase]-Linker2-[nucleobase editing domain]-COOH; or NH2-[inosine BER inhibitor]$NH_2$-[nucleobase editing domain]-[deaminase]-[nucleobase editing domain]-COOH.

In some embodiments, the base editing fusion proteins provided herein need to be positioned at a precise location, for example, where a target base is placed within a defined region (e.g., a "deamination window"). In some embodiments, a target can be within a 4-base region. In some embodiments, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A defined target region can be a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a napDNAbp domain. In some embodiments, an NLS of the base editor is localized C-terminal to a napD-NAbp domain.

Non-limiting examples of protein domains which can be included in the fusion protein include a deaminase domain (e.g., adenosine deaminase or cytidine deaminase), a uracil glycosylase inhibitor (UGI) domain, epitope tags, reporter gene sequences, and/or protein domains having one or more of the following activities: methylase activity, demethylase activity, transcription activation activity, transcription repression activity, transcription release factor activity, gene silencing activity, chromatin modifying activity, epigenetic modifying activity, histone modification activity, RNA cleavage activity, and nucleic acid binding activity. Additional domains can be a heterologous functional domain. Such heterologous functional domains can confer a function activity, such as modification of a target polypeptide associated with target DNA (e.g., a histone, a DNA binding protein, etc.), leading to, for example, histone methylation, histone acetylation, histone ubiquitination, and the like. Other functions and/or activities conferred can include transposase activity, integrase activity, recombinase activity, ligase activity, ubiquitin ligase activity, deubiquitinating activity, adenylation activity, deadenylation activity, SUMOylation activity, deSUMOylation activity, or any combination of the above.

Other functions conferred can include methyltransferase activity, demethylase activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, remodeling activity, protease activity, oxidoreductase activity, transferase activity, hydrolase activity, lyase activity, isomerase activity, synthase activity, synthetase activity, and demyristoylation activity, or any combination thereof.

A domain may be detected or labeled with an epitope tag, a reporter protein, other binding domains. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions.

Methods of Using Fusion Proteins Comprising a Cytidine or Adenosine Deaminase and a Cas9 Domain Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

In some embodiments, a fusion protein of the invention is used for mutagenizing a target of interest. In particular, a cytidine deaminase or adenosine deaminase nucleobase editor described herein is capable of making multiple mutations within a target sequence. These mutations may affect the function of the target. For example, when a cytidine deaminase or adenosine deaminase nucleobase editor is used to target a regulatory region the function of the regulatory region is altered and the expression of the downstream protein is reduced or eliminated.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a Cas9 domain and a cytidine or adenosine deaminase, as disclosed herein, to a target site, e.g., a site comprising a mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/ domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or down-stream of the target nucleotide to be edited. Some exemplary guide RNA sequences suitable for targeting any of the provided fusion proteins to specific target sequences are provided herein.

Base Editor Efficiency

In some embodiments, the purpose of the methods provided herein is to disrupt the normal function of a gene product via gene editing. The nucleobase editing proteins provided herein can be validated for gene editing-based human therapeutics in vitro. It will be understood by the skilled artisan that the nucleobase editing proteins provided herein, e.g., the fusion proteins comprising a polynucleotide programmable nucleotide binding domain (e.g., Cas9) and a nucleobase editing domain (e.g., an adenosine deaminase domain or a cytidine deaminase domain) can be used to edit a nucleotide from A to G or C to T.

CRISPR-Cas9 nucleases have been widely used to mediate targeted genome editing. In most genome editing applications, Cas9 forms a complex with a guide polynucleotide (e.g., single guide RNA (sgRNA)) and induces a double-stranded DNA break (DSB) at the target site specified by the sgRNA sequence. Cells primarily respond to this DSB through the non-homologous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR). Unfortunately, under most non-perturbative conditions, HDR is inefficient, dependent on cell state and cell type, and dominated by a larger frequency of indels. As most of the known genetic variations associated with human disease are point mutations, methods that can more efficiently and cleanly make precise point mutations are needed. Base editing systems as provided herein provide a new way to provide genome editing without generating double-strand DNA breaks, without requiring a donor DNA template, and without inducing an excess of stochastic insertions and deletions.

In some embodiments, the present disclosure provides base editors that efficiently generate an intended mutation, such as a STOP codon, in a nucleic acid (e.g., a nucleic acid within a genome of a subject) without generating a signifi-cant number of unintended mutations, such as unintended point mutations. In some embodiments, an intended muta-tion is a mutation that is generated by a specific base editor (e.g., adenosine base editor or cytidine base editor) bound to a guide polynucleotide (e.g., gRNA), specifically designed to generate the intended mutation. In some embodiments, the intended mutation is in a gene associated with a target antigen associated with a disease or disorder, e.g., T- or NK-cell malignancy. In some embodiments, the intended mutation is an adenine (A) to guanine (G) point mutation (e.g., SNP) in a gene associated with a target antigen associated with a disease or disorder, e.g., T- or NK-cell malignancy. In some embodiments, the intended mutation is an adenine (A) to guanine (G) point mutation within the coding region or non-coding region of a gene (e.g., regula-tory region or element). In some embodiments, the intended mutation is a cytosine (C) to thymine (T) point mutation (e.g., SNP) in a gene associated with a target antigen associated with a disease or disorder, e.g., T- or NK-cell malignancy. In some embodiments, the intended mutation is a cytosine (C) to thymine (T) point mutation within the coding region or non-coding region of a gene (e.g., regula-tory region or element). In some embodiments, the intended mutation is a point mutation that generates a STOP codon, for example, a premature STOP codon within the coding region of a gene. In some embodiments, the intended mutation is a mutation that eliminates a stop codon.

The base editors of the invention advantageously modify a specific nucleotide base encoding a protein without gen-erating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate) a specific nucleotide within a nucleic acid, without generating a large number of insertions or deletions (i.e., indels) in the nucleic acid. In some embodiments, it is desirable to generate base editors that efficiently modify (e.g. mutate or methylate) a specific nucleotide within a nucleic acid, without generating a large number of insertions or deletions (i.e., indels) in the nucleic acid. In certain embodiments, any of the base editors pro-vided herein can generate a greater proportion of intended modifications (e.g., methylations) versus indels. In certain embodiments, any of the base editors provided herein can generate a greater proportion of intended modifications (e.g., mutations) versus indels.

In some embodiments, the base editors provided herein are capable of generating a ratio of intended mutations to indels (i.e., intended point mutations:unintended point muta-tions) that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method.

In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein can limit the formation of indels at a region of a nucleic acid to less than T %, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, a number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation in a nucleic acid (e.g. a nucleic acid within a genome of a subject) without generating a considerable number of unintended mutations (e.g., spurious off-target editing or bystander editing). In some embodiments, an intended mutation is a mutation that is generated by a specific base editor bound to a gRNA, specifically designed to generate the intended mutation. In some embodiments, the intended mutation is a mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended mutations:unintended mutations) that is greater than 1:1. In some embodiments, any of the base editors provided herein are capable of generating a ratio of intended mutations to unintended mutations that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described herein may be applied to any of the fusion proteins, or methods of using the fusion proteins provided herein.

Base editing is often referred to as a "modification", such as, a genetic modification, a gene modification and modification of the nucleic acid sequence and is clearly understandable based on the context that the modification is a base editing modification. A base editing modification is therefore a modification at the nucleotide base level, for example as a result of the deaminase activity discussed throughout the disclosure, which then results in a change in the gene sequence, and may affect the gene product. In essence therefore, the gene editing modification described herein may result in a modification of the gene, structurally and/or functionally, wherein the expression of the gene product may be modified, for example, the expression of the gene is knocked out; or conversely, enhanced, or, in some circumstances, the gene function or activity may be modified. Using the methods disclosed herein, a base editing efficiency may be determined as the knockdown efficiency of the gene in which the base editing is performed, wherein the base editing is intended to knockdown the expression of the gene. A knockdown level may be validated quantitatively by determining the expression level by any detection assay, such as assay for protein expression level, for example, by flow cytometry; assay for detecting RNA expression such as quantitative RT-PCR, northern blot analysis, or any other suitable assay such as pyrosequencing; and may be validated qualitatively by nucleotide sequencing reactions.

In some embodiments, the modification, e.g., single base edit results in at least 10% reduction of the gene targeted expression. In some embodiments, the base editing efficiency may result in at least 10% reduction of the gene targeted expression. In some embodiments, the base editing efficiency may result in at least 20% reduction of the gene targeted expression. In some embodiments, the base editing efficiency may result in at least 30% reduction of the gene targeted expression. In some embodiments, the base editing efficiency may result in at least 40% reduction of the gene targeted expression. In some embodiments, the base editing efficiency may result in at least 50% reduction of the gene targeted expression. In some embodiments, the base editing efficiency may result in at least 60% reduction of the targeted gene expression. In some embodiments, the base editing efficiency may result in at least 70% reduction of the targeted gene expression. In some embodiments, the base editing efficiency may result in at least 80% reduction of the targeted gene expression. In some embodiments, the base editing efficiency may result in at least 90% reduction of the targeted gene expression. In some embodiments, the base editing efficiency may result in at least 91% reduction of the targeted gene expression. In some embodiments, the base editing efficiency may result in at least 92% reduction of the targeted gene expression. In some embodiments, the base editing efficiency may result in at least 93% reduction of the targeted gene expression. In some embodiments, the base editing efficiency may result in at least 94% reduction of the targeted gene expression. In some embodiments, the base editing efficiency may result in at least 95% reduction of the targeted gene expression. In some embodiments, the base editing efficiency may result in at least 96% reduction of the targeted gene expression. In some embodiments, the base editing efficiency may result in at least 97% reduction of the targeted gene expression. In some embodiments, the base editing efficiency may result in at least 98% reduction of the targeted gene expression. In some embodiments, the base editing efficiency may result in at least 99% reduction of the targeted gene expression. In some embodiments, the base editing efficiency may result in knockout (100% knockdown of the gene expression) of the gene that is targeted.

In some embodiments, any of base editor systems provided herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence.

In some embodiments, targeted modifications, e.g., single base editing, are used simultaneously to target at least 4, 5, 6, 7, 8, 9, 10, 11, 12 13, 14, 15, 16, 17,18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 different endogenous sequences for base editing with different guide RNAs. In some embodiments, targeted modifications, e.g. single base editing, are used to sequentially target at least 4, 5, 6, 7, 8, 9, 10, 11, 12 13, 14, 15, 16, 17,18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 50, or more different endogenous gene sequences for base editing with different guide RNAs.

Some aspects of the disclosure are based on the recognition that any of the base editors provided herein are capable of efficiently generating an intended mutation, such as a point mutation, in a nucleic acid (e.g., a nucleic acid within a genome of a subject) without generating a significant number of unintended mutations, such as unintended point mutations (i.e., mutation of bystanders). In some embodiments, any of the base editors provided herein are capable of generating at least 0.01% of intended mutations (i.e., at least 0.01% base editing efficiency). In some embodiments, any of the base editors provided herein are capable of generating at least 0.01%, 1%, 2%, 3%, 4%, 5%, 10%, 15%, 20%, 25%, 30%, 40%, 45%, 50%, 60%, 70%, 80%, 90%, 95%, or 99% of intended mutations.

In some embodiments, any of base editor systems comprising one of the ABE8 base editor variants described herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence. In some embodiments, any of base editor systems comprising one of the ABE8 base editor variants described herein result in less than 0.8% indel formation in the target polynucleotide sequence. In some embodiments, any of base editor systems comprising one of the ABE8 base editor variants described herein result in at most 0.8% indel formation in the target polynucleotide sequence. In some embodiments, any of base editor systems comprising one of the ABE8 base editor variants described herein result in less than 0.3% indel formation in the target polynucleotide sequence. In some embodiments, any of base editor systems comprising one of the ABE8 base editor variants described results in lower indel formation in the target polynucleotide sequence compared to a base editor system comprising one of ABE7 base editors. In some embodiments, any of base editor systems comprising one of the ABE8 base editor variants described herein results in lower indel formation in the target polynucleotide sequence compared to a base editor system comprising an ABE7.10.

In some embodiments, any of base editor systems comprising one of the ABE8 base editor variants described herein has reduction in indel frequency compared to a base editor system comprising one of the ABE7 base editors. In some embodiments, any of base editor systems comprising one of the ABE8 base editor variants described herein has at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% reduction in indel frequency compared to a base editor system comprising one of the ABE7 base editors. In some embodiments, a base editor system comprising one of the ABE8 base editor variants described herein has at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% reduction in indel frequency compared to a base editor system comprising an ABE7.10.

The invention provides adenosine deaminase variants (e.g., ABE8 variants) that have increased efficiency and specificity. In particular, the adenosine deaminase variants described herein are more likely to edit a desired base within a polynucleotide, and are less likely to edit bases that are not intended to be altered (e.g., "bystanders").

In some embodiments, any of the base editing system comprising one of the ABE8 base editor variants described herein has reduced bystander editing or mutations. In some embodiments, an unintended editing or mutation is a bystander mutation or bystander editing, for example, base editing of a target base (e.g., A or C) in an unintended or non-target position in a target window of a target nucleotide sequence. In some embodiments, any of the base editing system comprising one of the ABE8 base editor variants described herein has reduced bystander editing or mutations compared to a base editor system comprising an ABE7 base editor, e.g., ABE7.10. In some embodiments, any of the base editing system comprising one of the ABE8 base editor variants described herein has reduced bystander editing or mutations by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% compared to a base editor system comprising an ABE7 base editor, e.g., ABE7.10. In some embodiments, any of the base editing system comprising one of the ABE8 base editor variants described herein has reduced bystander editing or mutations by at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold compared to a base editor system comprising an ABE7 base editor, e.g., ABE7.10.

In some embodiments, any of the base editing system comprising one of the ABE8 base editor variants described herein has reduced spurious editing. In some embodiments, an unintended editing or mutation is a spurious mutation or spurious editing, for example, non-specific editing or guide independent editing of a target base (e.g., A or C) in an unintended or non-target region of the genome. In some embodiments, any of the base editing system comprising one of the ABE8 base editor variants described herein has reduced spurious editing compared to a base editor system comprising an ABE7 base editor, e.g., ABE7.10. In some embodiments, any of the base editing system comprising one of the ABE8 base editor variants described herein has reduced spurious editing by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% compared to a base editor system comprising an ABE7 base editor, e.g., ABE7.10. In some embodiments, any of the base editing system comprising one of the ABE8 base editor variants described herein has reduced spurious editing by at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold compared to a base editor system comprising an ABE7 base editor, e.g., ABE7.10.

In some embodiments, any of the ABE8 base editor variants described herein have at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% base editing efficiency. In some embodiments, the base editing efficiency may be measured by calculating the percentage of edited nucleobases in a population of cells. In some embodiments, any of the ABE8 base editor variants described herein have base editing efficiency of at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited nucleobases in a population of cells.

In some embodiments, any of the ABE8 base editor variants described herein has higher base editing efficiency compared to the ABE7 base editors. In some embodiments, any of the ABE8 base editor variants described herein have at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300%, at least 310%, at least 320%, at least 330%, at least 340%, at least 350%, at least 360%, at least 370%, at least 380%, at least 390%, at least 400%, at least 450%, or at least 500% higher base editing efficiency compared to an ABE7 base editor, e.g., ABE7.10.

In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher base editing efficiency compared to an ABE7 base editor, e.g., ABE7.10.

In some embodiments, any of the ABE8 base editor variants described herein have at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% on-target base editing efficiency. In some embodiments, any of the ABE8 base editor variants described herein have on-target base editing efficiency of at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited target nucleobases in a population of cells.

In some embodiments, any of the ABE8 base editor variants described herein has higher on-target base editing efficiency compared to the ABE7 base editors. In some embodiments, any of the ABE8 base editor variants described herein have at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300%, at least 310%, at least 320%, at least 330%, at least 340%, at least 350%, at least 360%, at least 370%, at least 380%, at least 390%, at least 400%, at least 450%, or at least 500% higher on-target base editing efficiency compared to an ABE7 base editor, e.g., ABE7.10.

In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher on-target base editing efficiency compared to an ABE7 base editor, e.g., ABE7.10.

The ABE8 base editor variants described herein may be delivered to a host cell via a plasmid, a vector, a LNP complex, or an mRNA. In some embodiments, any of the ABE8 base editor variants described herein is delivered to a host cell as an mRNA. In some embodiments, an ABE8 base editor delivered via a nucleic acid based delivery system, e.g., an mRNA, has on-target editing efficiency of at least at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited nucleobases. In some embodiments, an ABE8 base editor delivered by an mRNA system has higher base editing efficiency compared to an ABE8 base editor delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300% higher, at least 310%, at least 320%, at least 330%, at least 340%, at least 350%, at least 360%, at least 370%, at least 380%, at least 390%, at least 400%, at least 450%, or at least 500% on-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher on-target editing efficiency when delivered by an mRNA system compared to when delivered by a plasmid or vector system.

In some embodiments, any of base editor systems comprising one of the ABE8 base editor variants described herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% off-target editing in the target polynucleotide sequence.

In some embodiments, any of the ABE8 base editor variants described herein has lower guided off-target editing efficiency when delivered by an mRNA system compared to when delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% lower guided off-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold lower guided off-target editing efficiency when delivered by an mRNA system compared to when delivered by a plasmid or vector system. In some embodiments, any of the ABE8 base editor variants described herein has at least about 2.2 fold decrease in guided off-target editing efficiency when delivered by an mRNA system compared to when delivered by a plasmid or vector system.

In some embodiments, any of the ABE8 base editor variants described herein has lower guide-independent off-target editing efficiency when delivered by an mRNA system compared to when delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% lower guide-independent off-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 5.0 fold, at least 10.0 fold, at least 20.0 fold, at least 50.0 fold, at least 70.0 fold, at least 100.0 fold, at least 120.0 fold, at least 130.0 fold, or at least 150.0 fold lower guide-independent off-target editing efficiency when delivered by an mRNA system compared to when delivered by a plasmid or vector system. In some embodiments, ABE8 base editor variants described herein has 134.0 fold decrease in guide-independent off-target editing efficiency (e.g., spurious RNA deamination) when delivered by an mRNA system compared to when delivered by a plasmid or vector system. In some embodiments, ABE8 base editor variants described herein does not increase guide-independent mutation rates across the genome.

In some embodiments, a single gene delivery event (e.g., by transduction, transfection, electroporation or any other method) can be used to target base editing of 5 sequences within a cell's genome. In some embodiments, a single gene delivery event can be used to target base editing of 6 sequences within a cell's genome. In some embodiments, a single gene delivery event can be used to target base editing of 7 sequences within a cell's genome. In some embodiments, a single electroporation event can be used to target base editing of 8 sequences within a cell's genome. In some embodiments, a single gene delivery event can be used to target base editing of 9 sequences within a cell's genome. In some embodiments, a single gene delivery event can be used to target base editing of 10 sequences within a cell's genome. In some embodiments, a single gene delivery event can be used to target base editing of 20 sequences within a cell's genome. In some embodiments, a single gene delivery event can be used to target base editing of 30 sequences within a cell's genome. In some embodiments, a single gene delivery event can be used to target base editing of 40 sequences within a cell's genome. In some embodiments, a single gene delivery event can be used to target base editing of 50 sequences within a cell's genome.

In some embodiments, the method described herein, for example, the base editing methods has minimum to no off-target effects.

In some embodiments, the base editing method described herein results in at least 50% of a cell population that have been successfully edited (i.e., cells that have been successfully engineered). In some embodiments, the base editing method described herein results in at least 55% of a cell population that have been successfully edited. In some embodiments, the base editing method described herein results in at least 60% of a cell population that have been successfully edited. In some embodiments, the base editing method described herein results in at least 65% of a cell population that have been successfully edited. In some embodiments, the base editing method described herein results in at least 70% of a cell population that have been successfully edited. In some embodiments, the base editing method described herein results in at least 75% of a cell population that have been successfully edited. In some embodiments, the base editing method described herein results in at least 80% of a cell population that have been successfully edited. In some embodiments, the base editing method described herein results in at least 85% of a cell population that have been successfully edited. In some embodiments, the base editing method described herein results in at least 90% of a cell population that have been successfully edited. In some embodiments, the base editing method described herein results in at least 95% of a cell population that have been successfully edited. In some embodiments, the base editing method described herein results in about 91%, 92%, 93%, 94%, 95%, 96%, 97%, 98%, 99% or 100% of a cell population that have been successfully edited.

In some embodiments, the live cell recovery following a base editing intervention is greater than at least 60%, 70%, 80%, 90% of the starting cell population at the time of the base editing event. In some embodiments, the live cell recovery as described above is about 70%. In some embodiments, the live cell recovery as described above is about 75%. In some embodiments, the live cell recovery as described above is about 80%. In some embodiments, the live cell recovery as described above is about 85%. In some embodiments, the live cell recovery as described above is about 90%, or about 91%, 92%, 93%, 94% 95%, 96%, 97%, 98%, or 99%, or 100% of the cells in the population at the time of the base editing event.

In some embodiments the engineered cell population can be further expanded in vitro by about 2 fold, about 3-fold, about 4-fold, about 5-fold, about 6-fold, about 7-fold, about 8-fold, about 9-fold, about 10-fold, about 15-fold, about 20-fold, about 25-fold, about 30-fold, about 35-fold, about 40-fold, about 45-fold, about 50-fold, or about 100-fold.

The number of intended mutations and indels can be determined using any suitable method, for example, as described in International PCT Application Nos. PCT/2017/045381 (WO2018/027078) and PCT/US2016/058344 (WO2017/070632); Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017); the entire contents of which are hereby incorporated by reference.

In some embodiments, to calculate indel frequencies, sequencing reads are scanned for exact matches to two 10-bp sequences that flank both sides of a window in which indels can occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively. In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor.

The number of indels formed at a target nucleotide region can depend on the amount of time a nucleic acid (e.g., a nucleic acid within the genome of a cell) is exposed to a base editor. In some embodiments, the number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing the target nucleotide sequence (e.g., a nucleic acid within the genome of a cell) to a base editor. It should be appreciated that the characteristics of the base editors as described herein can be applied to any of the fusion proteins, or methods of using the fusion proteins provided herein.

Details of base editor efficiency are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference. In some embodiments, editing of a plurality of nucleobase pairs in one or more genes using the methods provided herein results in formation of at least one intended mutation. In some embodiments, said formation of said at least one intended mutation results in the disruption of the normal function of a gene. In some embodiments, said formation of said at least one intended mutation results decreases or eliminates the expression of a protein encoded by a gene. It should be appreciated that multiplex editing can be accomplished using any method or combination of methods provided herein.

Multiplex Editing

In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more gene, wherein at least one gene is located in a different locus. In some embodiments, the multiplex editing can comprise one or more guide polynucleotides. In some embodiments, the multiplex editing can comprise one or more base editor systems. In some embodiments, the multiplex editing can comprise one or more base editor systems with a single guide polynucleotide. In some embodiments, the multiplex editing can comprise one or more base editor systems with a plurality of guide polynucleotides. In some embodiments, the multiplex editing can comprise one or more guide polynucleotides with a single base editor system. In some embodiments, the multiplex editing can comprise at least one guide polynucleotide that does not require a PAM sequence to target binding to a target polynucleotide sequence. In some embodiments, multiplex editing can comprise at least one guide polynucleotide that requires a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any combination of methods using any base editor provided herein. It should also be appreciated that the multiplex editing using any of the base editors as described herein can comprise a sequential editing of a plurality of nucleobase pairs.

In some embodiments, the plurality of nucleobase pairs are in one more genes. In some embodiments, the plurality of nucleobase pairs is in the same gene. In some embodiments, at least one gene in the one more genes is located in a different locus.

In some embodiments, the editing is editing of the plurality of nucleobase pairs in at least one protein coding region. In some embodiments, the editing is editing of the plurality of nucleobase pairs in at least one protein non-coding region. In some embodiments, the editing is editing of the plurality of nucleobase pairs in at least one protein coding region and at least one protein non-coding region.

In some embodiments, the editing is in conjunction with one or more guide polynucleotides. In some embodiments, the base editor system can comprise one or more base editor system. In some embodiments, the base editor system can comprise one or more base editor systems in conjunction with a single guide polynucleotide. In some embodiments, the base editor system can comprise one or more base editor system in conjunction with a plurality of guide polynucleotides. In some embodiments, the editing is in conjunction with one or more guide polynucleotide with a single base editor system. In some embodiments, the editing is in conjunction with at least one guide polynucleotide that does not require a PAM sequence to target binding to a target polynucleotide sequence. In some embodiments, the editing is in conjunction with at least one guide polynucleotide that require a PAM sequence to target binding to a target polynucleotide sequence. In some embodiments, the editing is in conjunction with a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that the editing can comprise a sequential editing of a plurality of nucleobase pairs.

In some embodiments, the base editor system capable of multiplex editing of a plurality of nucleobase pairs in one or more genes comprises one of ABE9 base editors. In some embodiments, the base editor system capable of multiplex editing of a plurality of nucleobase pairs in one or more genes comprises one of the ABE8 base editor variants described herein. In some embodiments, the base editor system capable of multiplex editing of a plurality of nucleobase pairs in one or more genes comprises one of ABE7 base editors. In some embodiments, the base editor system capable of multiplex editing comprising one of the ABE8 base editor variants described herein has higher multiplex editing efficiency compared the base editor system capable of multiplex editing comprising one of ABE7 base editors. In some embodiments, the base editor system capable of multiplex editing comprising one of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least $1^{65}$%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300% higher, at least 310%, at least 320%, at least 330%, at least 340%, at least 350%, at least 360%, at least 370%, at least 380%, at least 390%, at least 400%, at least 450%, or at least 500% higher multiplex editing efficiency compared the base editor system capable of multiplex editing comprising one of ABE7 base editors. In some embodiments, the base editor system capable of multiplex editing comprising one of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 4.0 fold, at least 4.5 fold, at least 5.0 fold, at least 5.5 fold, or at least 6.0 fold higher multiplex editing efficiency compared the base editor system capable of multiplex editing comprising one of ABE7 base editors.

Delivery System

The suitability of nucleobase editors to target one or more nucleotides in a gene (e.g., CD2) is evaluated as described herein. In one embodiment, a single cell of interest is transfected, transduced, or otherwise modified with a nucleic acid molecule or molecules encoding a base editing system described herein together with a small amount of a vector encoding a reporter (e.g., GFP). These cells can be any cell line known in the art, including immune cells (e.g., T- or NK-cells), or immortalized human cell lines, such as 293T, K562 or U20S. Alternatively, primary cells (e.g., human) may be used. Cells may also be obtained from a subject or individual, such as from tissue biopsy, surgery, blood, plasma, serum, or other biological fluid. Such cells may be relevant to the eventual cell target.

Delivery may be performed using a viral vector. In one embodiment, transfection may be performed using lipid transfection (such as Lipofectamine or Fugene) or by electroporation. Following transfection, expression of a reporter (e.g., GFP) can be determined either by fluorescence microscopy or by flow cytometry to confirm consistent and high levels of transfection. These preliminary transfections can comprise different nucleobase editors to determine which combinations of editors give the greatest activity. The system can comprise one or more different vectors. In one embodiment, the base editor is codon optimized for expression of the desired cell type, preferentially a eukaryotic cell, preferably a mammalian cell or a human cell.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed using next generation sequencing (NGS) techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). The fusion proteins that induce the greatest levels of target specific alterations in initial tests can be selected for further evaluation.

In particular embodiments, the nucleobase editors are used to target polynucleotides of interest. In one embodiment, a nucleobase editor of the invention is delivered to cells (e.g., immune cells (e.g., T- or NK-cells)) in conjunction with one or more guide RNAs that are used to target one or more nucleic acid sequences of interest within the genome of a cell, thereby altering the target gene(s) (e.g., a CD2). In some embodiments, a base editor is targeted by one or more guide RNAs to introduce one or more edits to the sequence of one or more genes of interest (e.g., CD2, TRAC, B2M, CIITA, TRBC1, TRBC2, PD-1, CD52). In some embodiments, the one or more edits to the sequence of one or more genes of interest decrease or eliminate expression of the protein encoded by the gene in the host cell (e.g., immune cells (e.g., T- or NK-cells)). In some embodiments, expression of one or more proteins encoded by one or more genes of interest (e.g., CD2) is completely knocked out or eliminated in the host cell (e.g., immune cells (e.g., T- or NK-cells)).

In some embodiments, the host cell is a mammalian cell. In some embodiments, the host cell is a human cell. In some embodiments, the host cell is an immune cell. In some embodiments, the immune cell is a T cell. In some embodiments, the immune cell is a NK cell. In some embodiments, the one or more edits are introduced into one or more genes selected from CD2, CD3, CD5, CD7, CD52, B2M, CIITA, TRBC1, TRBC2, TRAC, and PD-1, or combinations thereof. In some embodiments, the one or more edits are introduced into the CD2 gene. In some embodiments, the one or more edits are introduced into the CD5 gene. In some embodiments, the one or more edits are introduced into the CD7 gene. In some embodiments, the one or more edits are introduced into the CD2, CD52, TRAC, and PD-1 genes. In some embodiments, the one or more edits are introduced into the CD5, CD52, TRAC, and PD-1 genes. In some embodiments, the one or more edits are introduced into the CD7, CD3, CD52, and PD-1 genes.

Nucleic Acid-Based Delivery of Nucleobase Editors and gRNAs

Nucleic acids encoding a cytidine or adenosine deaminase nucleobase editor according to the present disclosure can be administered to subjects or delivered into cells in vitro or in vivo by art-known methods or as described herein. For example, cytidine or adenosine deaminase nucleobase editors can be delivered by, e.g., vectors (e.g., viral or non-viral vectors), non-vector based methods (e.g., using naked DNA, DNA complexes, lipid nanoparticles), or a combination thereof.

Nucleic acids encoding cytidine or adenosine deaminase nucleobase editors can be delivered directly to cells (e.g., immune cells) as naked DNA or RNA, for instance by means of transfection or electroporation, or can be conjugated to molecules (e.g., N-acetylgalactosamine) promoting uptake by the target cells. Nucleic acid vectors, such as the vectors described herein can also be used. In particular embodiments, a polynucleotide, e.g. a mRNA encoding a base editor or a functional component thereof may be co-electroporated with a combination of multiple guide RNAs as described herein.

Nucleic acid vectors can comprise one or more sequences encoding a domain of a fusion protein described herein. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40), and one or more deaminases.

The nucleic acid vector can also include any suitable number of regulatory/control elements, e.g., promoters, enhancers, introns, polyadenylation signals, Kozak consensus sequences, or internal ribosome entry sites (IRES). These elements are well known in the art.

Nucleic acid vectors according to this disclosure include recombinant viral vectors. Exemplary viral vectors are set forth herein above. Other viral vectors known in the art can also be used. In addition, viral particles can be used to deliver genome editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems according to the present disclosure. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 18 (below).

TABLE 18

| Lipids Used for Gene Transfer | | |
| --- | --- | --- |
| Lipid | Abbreviation | Feature |
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |

TABLE 18-continued

| Lipids Used for Gene Transfer | | |
|---|---|---|
| Lipid | Abbreviation | Feature |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 19 lists exemplary polymers for use in gene transfer and/or nanoparticle formulations.

TABLE 19

| Polymers Used for Gene Transfer | |
|---|---|
| Polymer | Abbreviation |
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |

TABLE 19-continued

| Polymers Used for Gene Transfer | |
|---|---|
| Polymer | Abbreviation |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 20 summarizes delivery methods for a polynucleotide encoding a fusion protein described herein.

TABLE 20

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

In another aspect, the delivery of genome editing system components or nucleic acids encoding such components, for example, a nucleic acid binding protein such as, for example, Cas9 or variants thereof, and a gRNA targeting a genomic nucleic acid sequence of interest, may be accomplished by delivering a ribonucleoprotein (RNP) to cells. The RNP comprises the nucleic acid binding protein, e.g., Cas9, in complex with the targeting gRNA. RNPs may be delivered to cells using known methods, such as electroporation, nucleofection, or cationic lipid-mediated methods, for example, as reported by Zuris, J. A. et al., 2015, Nat. Biotechnology, 33(1):73-80. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid based techniques, RNPs can be used to deliver binding protein (e.g., Cas9 variants) and to direct homology directed repair (HDR).

A promoter used to drive base editor coding nucleic acid molecule expression can include AAV ITR. This can be advantageous for eliminating the need for an additional promoter element, which can take up space in the vector. The additional space freed up can be used to drive the expression of additional elements, such as a guide nucleic acid or a selectable marker. ITR activity is relatively weak, so it can be used to reduce potential toxicity due to over expression of the chosen nuclease.

Any suitable promoter can be used to drive expression of the base editor and, where appropriate, the guide nucleic acid. For ubiquitous expression, promoters that can be used include CMV, CAG, CBh, PGK, SV40, Ferritin heavy or light chains, etc. For brain or other CNS cell expression, suitable promoters can include: SynapsinI for all neurons, CaMKIIalpha for excitatory neurons, GAD67 or GAD65 or VGAT for GABAergic neurons, etc. For liver cell expression, suitable promoters include the Albumin promoter. For lung cell expression, suitable promoters can include SP-B. For endothelial cells, suitable promoters can include ICAM. For hematopoietic cells suitable promoters can include IFN-beta or CD45. For Osteoblasts suitable promoters can include OG-2.

In some embodiments, a base editor of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters such as U6 or H1 Use of Pol II promoter and intronic cassettes to express gRNA Adeno Associated Virus (AAV).

In particular embodiments, a fusion protein of the invention is encoded by a polynucleotide present in a viral vector (e.g., adeno-associated virus (AAV), AAV3, AAV3b, AAV4, AAV5, AAV6, AAV7, AAV8, AAV9, AAVrh8, AAV10, and variants thereof), or a suitable capsid protein of any viral vector. Thus, in some aspects, the disclosure relates to the viral delivery of a fusion protein. Examples of viral vectors include retroviral vectors (e.g. Maloney murine leukemia virus, MML-V), adenoviral vectors (e.g. AD100), lentiviral vectors (HIV and FIV-based vectors), herpesvirus vectors (e.g. HSV-2).

In some aspects, the methods described herein for editing specific genes in an immune cell can be used to genetically modify a CAR-T cell. Such CAR-T cells, and methods to produce such CAR-T cells are described in International Application Nos. PCT/US2016/060736, PCT/US2016/060734, PCT/US2016/034873, PCT/US2015/040660, PCT/EP2016/055332, PCT/IB2015/058650, PCT/EP2015/067441, PCT/EP2014/078876, PCT/EP2014/059662, PCT/IB2014/061409, PCT/US2016/019192, PCT/US2015/059106, PCT/US2016/052260, PCT/US2015/020606, PCT/US2015/055764, PCT/CN2014/094393, PCT/US2017/059989, PCT/US2017/027606, and PCT/US2015/064269, the contents of each is hereby incorporated in its entirety.

Viral Vectors

A base editor described herein can therefore be delivered with viral vectors. In some embodiments, a base editor disclosed herein can be encoded on a nucleic acid that is contained in a viral vector. In some embodiments, one or more components of the base editor system can be encoded on one or more viral vectors. For example, a base editor and guide nucleic acid can be encoded on a single viral vector. In other embodiments, the base editor and guide nucleic acid are encoded on different viral vectors. In either case, the base editor and guide nucleic acid can each be operably linked to a promoter and terminator. The combination of components encoded on a viral vector can be determined by the cargo size constraints of the chosen viral vector.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

Viral vectors can include lentivirus (e.g., HIV and FIV-based vectors), Adenovirus (e.g., AD100), Retrovirus (e.g., Maloney murine leukemia virus, MML-V), herpesvirus vectors (e.g., HSV-2), and Adeno-associated viruses (AAVs), or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as in U.S. Pat. No. 8,454,972 and as in clinical trials involving AAV. For Adenovirus, the route of administration, formulation and dose can be as in U.S. Pat.

No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (See, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some aspects, a base editor of the present disclosure is of sufficient size so as to enable efficient packaging and delivery into a target cell via a retroviral vector. In some embodiments, a base editor is of a size so as to allow efficient packing and delivery even when expressed together with a guide nucleic acid and/or other components of a targetable nuclease system.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, Adeno-associated virus ("AAV") vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper. The helper virus can promote replication of the AAV vector and expression of AAV genes from the helper plasmid. The helper plasmid in some cases is not packaged in significant amounts due to a lack of ITR sequences. Contamination with adenovirus can be reduced by, e.g., heat treatment to which adenovirus is more sensitive than AAV.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors can also be used to transduce cells with target nucleic acids, e.g., in the in vitro production of nucleic acids and peptides, and for in vivo and ex vivo gene therapy procedures (See, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1.

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

Viral vectors can be selected based on the application. For example, for in vivo gene delivery, AAV can be advantageous over other viral vectors. In some embodiments, AAV allows low toxicity, which can be due to the purification method not requiring ultra-centrifugation of cell particles that can activate the immune response. In some embodiments, AAV allows low probability of causing insertional mutagenesis because it doesn't integrate into the host genome. Adenoviruses are commonly used as vaccines because of the strong immunogenic response they induce. Packaging capacity of the viral vectors can limit the size of the base editor that can be packaged into the vector.

AAV has a packaging capacity of about 4.5 Kb or 4.75 Kb including two 145 base inverted terminal repeats (ITRs). This means disclosed base editor as well as a promoter and transcription terminator can fit into a single viral vector.

Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some embodiments, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. A tabulation of certain AAV serotypes as to these cells can be found in Grimm, D. et al, J. Virol. 82: 5887-5911 (2008)).

In some embodiments, lentiviral vectors are used to transduce a modified immune cell (e.g., T- or NK-cell) with a chimeric antigen receptor. Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media is changed to OptiMEM (serum-free) media and transfection was done 4 hours later. Cells are transfected with 10 µg of lentiviral transfer plasmid (pCasES10) and the following packaging plasmids: 5 µg of pMD2.G (VSV-g pseudotype), and 7.5 pg of psPAX2 (gag/pol/rev/tat). Transfection can be done in 4 mL OptiMEM with a cationic lipid delivery agent (50 pl Lipofectamine 2000 and 100 pl Plus reagent). After 6 hours, the media is changed to antibiotic-free DMEM with 10% fetal bovine serum. These methods use serum during cell culture, but serum-free methods are preferred.

Lentivirus can be purified as follows. Viral supernatants are harvested after 48 hours. Supernatants are first cleared of debris and filtered through a 0.45 µm low protein binding (PVDF) filter. They are then spun in an ultracentrifuge for 2 hours at 24,000 rpm. Viral pellets are resuspended in 50 µl of DMEM overnight at 4° C. They are then aliquoted and immediately frozen at −80° C.

In another embodiment, minimal non-primate lentiviral vectors based on the equine infectious anemia virus (EIAV) are also contemplated. In another embodiment, RetinoStat®, an equine infectious anemia virus-based lentiviral gene therapy vector that expresses angiostatic proteins endostatin and angiostatin that is contemplated to be delivered via a subretinal injection. In another embodiment, use of self-inactivating lentiviral vectors are contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional kozak sequence (GC-CACC), nuclease sequence, and 3' UTR such as a 3' UTR from beta globin-polyA tail. The cassette can be used for transcription by T7 polymerase. Guide polynucleotides (e.g., gRNA) can also be transcribed using in vitro transcription from a cassette containing a T7 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In one embodiment, dual AAV vectors are generated by splitting a large transgene expression cassette in two separate halves (5' and 3' ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5' and 3' genomes (dual AAV overlapping vectors); (2) ITR-mediated tail-to-head concatemerization of 5' and 3' genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

Inteins

Inteins (intervening protein) are auto-processing domains found in a variety of diverse organisms, which carry out a process known as protein splicing. Protein splicing is a multi-step biochemical reaction comprised of both the cleavage and formation of peptide bonds. While the endogenous substrates of protein splicing are proteins found in intein-containing organisms, inteins can also be used to chemically manipulate virtually any polypeptide backbone.

In protein splicing, the intein excises itself out of a precursor polypeptide by cleaving two peptide bonds, thereby ligating the flanking extein (external protein) sequences via the formation of a new peptide bond. This rearrangement occurs post-translationally (or possibly co-translationally). Intein-mediated protein splicing occurs spontaneously, requiring only the folding of the intein domain.

About 5% of inteins are split inteins, which are transcribed and translated as two separate polypeptides, the N-intein and C-intein, each fused to one extein. Upon translation, the intein fragments spontaneously and non-covalently assemble into the canonical intein structure to carry out protein splicing in trans. The mechanism of protein splicing entails a series of acyl-transfer reactions that result in the cleavage of two peptide bonds at the intein-extein junctions and the formation of a new peptide bond between the N- and C-exteins. This process is initiated by activation of the peptide bond joining the N-extein and the N-terminus of the intein. Virtually all inteins have a cysteine or serine at their N-terminus that attacks the carbonyl carbon of the C-terminal N-extein residue. This N to O/S acyl-shift is facilitated by a conserved threonine and histidine (referred to as the TXXH motif), along with a commonly found aspartate, which results in the formation of a linear (thio) ester intermediate. Next, this intermediate is subject to trans-(thio)esterification by nucleophilic attack of the first C-extein residue (+1), which is a cysteine, serine, or threonine. The resulting branched (thio)ester intermediate is resolved through a unique transformation: cyclization of the highly conserved C-terminal asparagine of the intein. This process is facilitated by the histidine (found in a highly conserved HNF motif) and the penultimate histidine and may also involve the aspartate. This succinimide formation reaction excises the intein from the reactive complex and leaves behind the exteins attached through a non-peptidic linkage. This structure rapidly rearranges into a stable peptide bond in an intein-independent fashion.

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, an N-terminal fragment of a base editor (e.g., ABE, CBE) is fused to a split intein-N and a C-terminal fragment is fused to a split intein-C. These fragments are then packaged into two or more AAV vectors. In some embodiments, the N-terminus of an intein is fused to the C-terminus of a fusion protein and the C-terminus of the intein is fused to the N-terminus of an AAV capsid protein.

In one embodiment, inteins are utilized to join fragments or portions of a cytidine or adenosine deaminase base editor protein that is grafted onto an AAV capsid protein. The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

In some embodiments, an ABE was split into N- and C-terminal fragments at Ala, Ser, Thr, or Cys residues within selected regions of SpCas9. These regions correspond to loop regions identified by Cas9 crystal structure analysis. The N-terminus of each fragment is fused to an intein-N and the C-terminus of each fragment is fused to an intein C at amino acid positions S303, T310, T313, S355, A456, S460, A463, T466, S469, T472, T474, C574, S577, A589, and S590, which are indicated in bold capital letters in the sequence below.

```
  1 mdkkysigld igtnsvgwav itdeykvpsk ktkvigntdr hsikknliga llfdsgetae 61 atrlkrtarr rytrrknric ylqeifsnem akvddsffhr leesflveed kkherhpifg 121 nivdevayhe kyptiyhlrk klvdstdkad lrliylalah mikfrghfli egdlnpdnsc 181 vdklfiqlvq tynqlfeenp inasgydaka ilsarlsksr rlenliaqlp gekknglfgn 241 lialslgltp nfksnfdlae daklqlskdt ydddldnlla qigdqyadlf laaknlsdai 301 llSdilrvnT eiTkaplsas mikrydehhq dltllkalvr qqlpekykei ffdqSkngya 361 gyidggasqe efykfikpil ekmdgteell vklnredllr kqrtfdngsi phqihlgelh 421 ailrrqedfy pflkdnreki ekiltfripy yvgplArgnS rfAwmTrkSe eTiTpwnfee 481 vvdkgasaqs fiermtnfdk nlpnekvlpk hsllyeyftv yneltkvkyv tegmrkpafl 541 sgeqkkaivd Ilfktnrkvt vkqlkedyfk kieCfdSvei sgvedrfnAS lgtyhdllki 601 ikdkdfldne enedilediv ltltlfedre mieerlktya hlfddkvmkq lkrrrytgwg 661 rlsrklingi rdkqsgktil dfiksdgfan rnfmqlihdd sltfkediqk aqvsgagdsl 721 hehianlags paikkgiiqt vkvvdelvkv mgrhkpenlv iemarenqtt qkgqknsrer 781 mkrieegike lgsqilkehp ventqlqnek lylyylqngr dmyvdqeldi nrlsdydvdh 841 ivpqsflkdd sidnkvltrs dknrgksdnv pseevvkkmk nywrqllnak litqrkfdnl 901 tkaergglse ldkagfikrq lvetrqitkh vaqildsrmn tkydendkli revkvitlks 961 klvsdfrkdf qfykvreinn yhhahdayln avvgtalikk ypklesefvy gdykvydvrk
```

```
1021 miakseqeig katakytfys nimnffktei tlangeirkr plietngetg eivwdkgrdf 1081 atvrkvlsmp qvnivkktev qtggfskesi lpkrnsdkli arkkdwdpkk yggfdsptva 1141 ysvlvvakve kgkskklksy kellgitime rssfeknpid fleakqykev kkdliiklpk 1201 yslfelengr krmlasagel qkgnelalps kyvnflylas hyeklkgspe dneqkqlfve 1261 qhkhyldeii eqisefskry iladanldkv lsaynkhrdk pireqaenii hlftltnlga 1321 paafkyfdtt idrkrytstk evldatlihq sitglyetri dlsqlggd
```

Use of Nucleobase Editors

Target antigens associated with neoplastic cells may also be expressed on healthy immune cells. Accordingly, using modified immune cells (e.g. CAR-T) cells to target the antigen on neoplastic cells may also result in the killing of healthy immune cells also expressing that antigen, otherwise known as fratricide or self-killing. The use of modified immune cells in combination with base editors that can decrease or eliminate the expression of a target antigen (e.g., CD2) on the modified immune cell to provide fratricide resistance provides new strategies for using gene correction with applications in therapeutics and basic research.

The present disclosure provides methods for producing a fratricide resistant modified immune cell. In some embodiments, a method is provided that comprises editing an immune cell (e.g., T- or NK-cell) obtained from a healthy subject or donor with a nucleobase editor (e.g., an adenosine deaminase base editor or a cytidine deaminase base editor) and one or more guide RNAs to decrease or eliminate the expression of a target antigen (e.g., CD2) on the immune cell (e.g., T- or NK-cell). The immune cell is then transduced with a chimeric antigen receptor directed to the target antigen (e.g., CD2). The resulting modified immune cell (e.g., CAR-T) is fratricide resistant and is able to target neoplastic cells without targeting healthy immune cells. In some embodiments, the fratricide resistant modified immune cell is produced as provided in Example 2. In some embodiments, a method is provided that produces a fratricide resistant CD2 CAR-T cell.

The present disclosure also provides methods for the treatment of a subject diagnosed with a disease (e.g., T- or NK-cell malignancy) using a modified immune cell as provided herein. In some embodiments, a method is provided that comprises administering an effective amount of a modified immune cell produced as provided herein to a subject having or having a propensity of having a disease (e.g., T- or NK-cell malignancy). The present disclosure provides methods for the treatment of T- or NK-cell malignancies that are associated with a target antigen that can be corrected by deaminase mediated gene editing. Suitable diseases that can be treated with the strategies and modified immune cells as provided herein will be apparent to those of skill in the art based on the instant disclosure.

Provided herein are methods of using a base editor or base editor system for editing a nucleobase in a target nucleotide sequence. In some embodiments, the activity of the base editor system (e.g., comprising a deaminase, a Cas9 domain, and one or more guide RNAs) results in the disruption of a splice site or results in introducing a premature STOP codon into the target nucleotide sequence.

In some embodiments, the deaminases (e.g., adenosine deaminase or cytidine deaminase) provided herein are capable of deaminating a deoxyadenosine residue of DNA. Other aspects of the disclosure provide fusion proteins that comprise a deaminase (e.g., an adenosine deaminase or cytidine deaminase) and a domain (e.g., a Cas9 or a Cpf1 protein) capable of binding to a specific nucleotide sequence. For example, adenosine can be converted to an inosine residue, which typically base pairs with a cytosine residue. Such fusion proteins are useful inter alia for targeted editing of nucleic acid sequences. Such fusion proteins can be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a G to A, or a T to C to mutation can be treated using the nucleobase editors provided herein. The present disclosure provides modified immune cells, fusion proteins, nucleic acids, vectors, compositions, methods, kits, systems, etc. that utilize the deaminases and nucleobase editors.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to a cytidine or adenosine deaminase) and a guide nucleic acid (e.g., gRNA), wherein the target region comprises a targeted nucleobase pair, b) inducing strand separation of said target region, c) converting a first nucleobase of said target nucleobase pair in a single strand of the target region to a second nucleobase, and d) cutting no more than one strand of said target region, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., C·G to T·A). In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the base editor protects or binds the non-edited strand. In some embodiments, the base editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In one embodiment, the linker is 32 amino acids in length. In another embodiment, a "long linker" is at least about 60 amino acids in length. In other embodiments, the linker is between about 3-100 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a methylation window.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments base editing by a method described herein may have a base conversion efficiency of at least 10% at any particular gene site. In some embodiments, base editing by a method described herein may have a base conversion efficiency of at least 20%, at least 25%, at least 30%, at least 35%, at least 40%, at least 45%, at least 50% at least 55% or at least 60%, at least 65%, at least 70%, at least 75%, at least 80%, at least 85%, at least 90%, or at least 95%, 96%, 97%, 98% or at least 99% at any particular gene site. In some embodiments base editing by a method described herein may have a base conversion efficiency of at least 70% at any particular gene site. In some embodiments base editing by a method described herein may have a base conversion efficiency of at least 80% at any particular gene site. In some embodiments base editing by a method described herein may have a base conversion efficiency of at least 90% at any particular gene site.

In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the nucleobase editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. e.g., In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Pharmaceutical Compositions

In some aspects, the present invention provides a pharmaceutical composition comprising any of the genetically modified immune cells, base editors, fusion proteins, or the fusion protein-guide polynucleotide complexes described herein. More specifically, provided herein are pharmaceutical compositions comprising a genetically modified immune cell, or a population of such immune cells, expressing a chimeric antigen receptor (CAR), wherein said modified immune cell, or a population thereof, has at least one edited gene to provide fratricide resistance, enhance the function of the modified immune cell or to reduce immunosuppression or inhibition of the modified immune cell, wherein expression of the edited gene is either knocked out or knocked down. In some embodiments the at least one edited gene is CD3, CD5, CD7, CD33, CD123, TRAC, LAG-3, FAS, CIITA, TRBC1, TRBC2, CD52, B2M, PDCD1/PD1, CBLB, TGFBR2, ZAP70, NFATc1, TET2, or combination thereof. In some embodiments, CD3, CD5, CD7, CD33, or CD123 is edited. In some embodiments, CD3, CD5, CD7, CD33, or CD123 is edited in combination with one or more genes selected from TRAC, LAG-3, FAS, CIITA, TRBC1, TRBC2, CD52, B2M, and PDCD1/PD1.

In some embodiments, the pharmaceutical composition comprises a modified immune effector cell (e.g., CAR-T cell) or population thereof that lacks or has reduced levels of CD5 and expresses a CD5 chimeric antigen receptor. In some embodiments, the pharmaceutical composition comprises a modified immune effector cell (e.g., CAR-T cell) or population thereof that lacks or has reduced levels of CD7 and expresses a CD7 chimeric antigen receptor. In some embodiments, the pharmaceutical composition comprises a modified immune effector cell (e.g., CAR-T cell) or population thereof that lacks or has reduced levels of CD33 and expresses a CD33 chimeric antigen receptor. In some embodiments, the pharmaceutical composition comprises a modified immune effector cell (e.g., CAR-T cell) or population thereof that lacks or has reduced levels of CD3 and expresses a CD3 chimeric antigen receptor. In some embodiments, the pharmaceutical composition comprises a modified immune effector cell (e.g., CAR-T cell) or population thereof that lacks or has reduced levels of CD123 and expresses a CD123 chimeric antigen receptor.

In some embodiments, the pharmaceutical composition comprises a modified immune effector cell (e.g., CAR-T cell) or population thereof that lacks or has reduced levels of CD5 and at least one edited gene selected from TRAC, LAG-3, FAS, CIITA, TRBC1, TRBC2, CD52, B2M, and PDCD1/PD1, and expresses a CD5 chimeric antigen receptor. In some embodiments, the pharmaceutical composition comprises a modified immune effector cell (e.g., CAR-T cell) or population thereof that lacks or has reduced levels of CD7 and at least one edited gene selected from TRAC, LAG-3, FAS, CIITA, TRBC1, TRBC2, CD52, B2M, and expresses a CD7 chimeric antigen receptor. In some embodiments, the pharmaceutical composition comprises a modified immune effector cell (e.g., CAR-T cell) or population thereof that lacks or has reduced levels of CD33 and at least one edited gene selected from TRAC, LAG-3, FAS, CIITA, TRBC1, TRBC2, CD52, B2M, and expresses a CD33 chimeric antigen receptor. In some embodiments, the pharmaceutical composition comprises a modified immune effector cell (e.g., CAR-T cell) or population thereof that lacks or has reduced levels of CD3 and at least one edited gene selected from TRAC, LAG-3, FAS, CIITA, TRBC1, TRBC2, CD52, B2M, and expresses a CD3 chimeric antigen receptor. In some embodiments, the pharmaceutical composition comprises a modified immune effector cell (e.g., CAR-T cell) or population thereof that lacks or has reduced levels of CD123 and at least one edited gene selected from TRAC, LAG-3, FAS, CIITA, TRBC1, TRBC2, CD52, B2M, and expresses a CD123 chimeric antigen receptor.

The pharmaceutical compositions of the present invention can be prepared in accordance with known techniques. See, e.g., Remington, The Science And Practice of Pharmacy (21st ed. 2005). In general, the immune cell, or population thereof is admixed with a suitable carrier prior to administration or storage, and in some embodiments, the pharmaceutical composition further comprises a pharmaceutically acceptable carrier. Suitable pharmaceutically acceptable carriers generally comprise inert substances that aid in administering the pharmaceutical composition to a subject, aid in processing the pharmaceutical compositions into deliverable preparations, or aid in storing the pharmaceutical composition prior to administration. Pharmaceutically acceptable carriers can include agents that can stabilize, optimize or otherwise alter the form, consistency, viscosity, pH, pharmacokinetics, solubility of the formulation. Such agents include buffering agents, wetting agents, emulsifying agents, diluents, encapsulating agents, and skin penetration enhancers. For example, carriers can include, but are not limited to, saline, buffered saline, dextrose, arginine, sucrose, water, glycerol, ethanol, sorbitol, dextran, sodium carboxymethyl cellulose, and combinations thereof.

Some nonlimiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g., tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In addition to the modified immune cell, or population thereof, and the carrier, the pharmaceutical compositions of the present invention can include at least one additional therapeutic agent useful in the treatment of disease. For example, some embodiments of the pharmaceutical composition described herein further comprises a chemotherapeutic agent. In some embodiments, the pharmaceutical composition further comprises a cytokine peptide or a nucleic acid sequence encoding a cytokine peptide. In some embodiments, the pharmaceutical compositions comprising the modified immune cell or population thereof can be administered separately from an additional therapeutic agent.

In some embodiments, the at least one additional therapeutic agent is one or more additional modified immune cells, or one or more populations of modified immune cells thereof. In some embodiments, the one or more additional modified immune effector cells comprise at least one edited gene to knockout or knockdown expression of the edited gene. In some embodiments, the at least one edited gene is CD3, CD5, CD7, CD33, CD123, TRAC, LAG-3, FAS, CIITA, TRBC1, TRBC2, CD52, B2M, PD1, or combinations thereof. In some embodiments, CD3, CD5, CD7, CD33, or CD123 is edited. In some embodiments, CD3, CD5, CD7, CD33, or CD123 is edited in combination with one or more genes selected from TRAC, LAG-3, FAS, CIITA, TRBC1, TRBC2, CD52, B2M, and/or PD1.

In some embodiments, the pharmaceutical compositions comprises two or more populations of modified immune cells thereof. In some embodiments, the pharmaceutical composition comprises 1) a modified immune effector cell (e.g., CAR-T cell) or population thereof that lacks or has reduced levels of CD5 and at least one edited gene selected from TRAC, LAG-3, FAS, CIITA, TRBC1, TRBC2, CD52, B2M, and expresses a CD5 chimeric antigen receptor; and 2) a modified immune effector cell (e.g., CAR-T cell) or population thereof that lacks or has reduced levels of CD7 and at least one edited gene selected from TRAC, LAG-3, FAS, CIITA, TRBC1, TRBC2, CD52, B2M, and expresses a CD7 chimeric antigen receptor.

In some embodiments, the pharmaceutical composition comprises 1) a modified immune effector cell (e.g., CAR-T cell) or population thereof that lacks or has reduced levels of CD33 and at least one edited gene selected from TRAC, LAG-3, FAS, CIITA, TRBC1, TRBC2, CD52, B2M, and expresses a CD33 chimeric antigen receptor; and 2) a modified immune effector cell (e.g., CAR-T cell) or population thereof that lacks or has reduced levels of CD123 and at least one edited gene selected from TRAC, LAG-3, FAS, CIITA, TRBC1, TRBC2, CD52, B2M, and expresses a CD123 chimeric antigen receptor.

The pharmaceutical compositions of the present invention can be used to treat any disease or condition that is responsive to autologous or allogeneic immune cell immunotherapy. For example, the pharmaceutical compositions, in some embodiments are useful in the treatment of neoplasia. In some embodiments, the neoplasia is a solid tumor. In other embodiments, the neoplasia is a liquid tumor. In some embodiments, the neoplasia is a hematological cancer. In some embodiments, the hematological cancer is a B cell cancer, and in some embodiments, the B cell cancer is multiple myeloma. In some embodiments, the B cell cancer is relapsed of relapsed/refractory multiple myeloma. In some embodiments, the hematological cancer is leukemia, myeloma, and/or lymphoma. In some cases, the leukemia is an acute leukemia. Acute leukemias include, for example, an acute myeloid leukemia (AML). Acute leukemias also include, for example, an acute lymphoid leukemia or an acute lymphocytic leukemia (ALL); ALL includes B-lineage ALL; T-lineage ALL; and T-cell acute lymphocytic leukemia (T-ALL).

Nonlimiting examples of neoplasia include T-cell acute lymphoblastic leukemia (T-ALL), mycosis fungoides (MF), Sézary syndrome (SS), Peripheral T/NK-cell lymphoma, Anaplastic large cell lymphoma ALK⁺, Primary cutaneous T-cell lymphoma, T-cell large granular lymphocytic leukemia, Angioimmunoblastic T/NK-cell lymphoma, Hepatosplenic T-cell lymphoma, Primary cutaneous CD30⁺ lymphoproliferative disorders, Extranodal NK/T-cell lymphoma, Adult T-cell leukemia/lymphoma, T-cell prolymphocytic leukemia, Subcutaneous panniculitis-like T-cell lymphoma, Primary cutaneous gamma-delta T-cell lymphoma, Aggressive NK-cell leukemia, and Enteropathy-associated T-cell lymphoma. In some embodiments, the neoplasia is T-cell acute lymphoblastic leukemia (T-ALL). In some embodiments, the neoplasia is acute myelogenous leukemia (AML).

In some embodiments, a subject having or having a propensity to develop a neoplasia (e.g., leukemia) is administered with an effective amount of one or more of 1) a modified immune effector cell (e.g., CAR-T cell) or population thereof that lacks or has reduced levels of CD5 and at least one edited gene selected from TRAC, LAG-3, FAS, CIITA, TRBC1, TRBC2, CD52, B2M, and PDCD1/PD1, and expresses a CD5 chimeric antigen receptor; 2) a modified immune effector cell (e.g., CAR-T cell) or population thereof that lacks or has reduced levels of CD7 and at least one edited gene selected from TRAC, LAG-3, FAS, CIITA, TRBC1, TRBC2, CD52, B2M, and expresses a CD7 chimeric antigen receptor; 3) a modified immune effector cell (e.g., CAR-T cell) or population thereof that lacks or has reduced levels of CD33 and at least one edited gene selected from TRAC, LAG-3, FAS, CIITA, TRBC1, TRBC2, CD52, B2M, and expresses a CD33 chimeric antigen receptor; and 4) a modified immune effector cell (e.g., CAR-T cell) or population thereof that lacks or has reduced levels of CD123 and at least one edited gene selected from TRAC, LAG-3, FAS, CIITA, TRBC1, TRBC2, CD52, B2M, and expresses a CD123 chimeric antigen receptor.

One consideration concerning the therapeutic use of genetically modified immune cells of the invention is the quantity of cells necessary to achieve an optimal or satisfactory effect. The quantity of cells to be administered may vary for the subject being treated. In one embodiment, between $10^4$ to $10^{10}$, between $10^5$ to $10^9$, or between $10^6$ and $10^8$ genetically modified immunoresponsive cells of the invention are administered to a human subject. In some embodiments, at least about $1\times10^8$, $2\times10^8$, $3\times10^8$, $4\times10^8$, and $5\times10^8$ genetically modified immune cells of the invention are administered to a human subject. Determining the precise effective dose may be based on factors for each individual subject, including their size, age, sex, weight, and condition. Dosages can be readily ascertained by those skilled in the art from this disclosure and the knowledge in the art.

The skilled artisan can readily determine the number of cells and amount of optional additives, vehicles, and/or carriers in compositions and to be administered in methods of the invention. Typically, additives (in addition to the active immune cell(s)) are present in an amount of 0.001 to 50% (weight) solution in phosphate buffered saline, and the active ingredient is present in the order of micrograms to milligrams, such as about 0.0001 to about 5 wt %, preferably about 0.0001 to about 1 wt %, still more preferably about 0.0001 to about 0.05 wt % or about 0.001 to about 20 wt %, preferably about 0.01 to about 10 wt %, and still more preferably about 0.05 to about 5 wt %. Of course, for any composition to be administered to an animal or human, and for any particular method of administration, it is preferred to determine therefore: toxicity, such as by determining the lethal dose (LD) and LD50 in a suitable animal model (e.g., a rodent such as a mouse); and, the dosage of the composition(s), concentration of components therein, and the timing of administering the composition(s), which elicit a suitable response. Such determinations do not require undue experimentation from the knowledge of the skilled artisan, this disclosure and the documents cited herein. And, the time for sequential administrations can be ascertained without undue experimentation.

In one embodiment, the method and compositions described herein may be used in generating engineered T cells that express a CAR and may have one or more base edited modifications, such that the engineered T cell can mount a specific immune response against the target. The CAR may be specifically directed towards an antigen target, the antigen may be presented by a cell in a host. In some embodiments, the immune response encompasses cytotoxicity. In some embodiments, the engineered T cell has enhanced cytotoxic response against its target. In some embodiments, the engineered T cell induces an enhanced cytotoxic response against its target as compared to a non-engineered T cell. In some embodiments, the engineered T cell exhibits an enhanced cytotoxic response by at least 1.1-fold, 1.5-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold or more compared to a non-engineered cell. In some embodiments, the engineered T cell can kill at least 10%, at least 20%, at least 30%, at least 40%, at least 50%, at least 60%, at least 70%, at least 80%, at least 90%, at least 100%, at least 200%, at least 500% or at least 1000% more target cells than a non-engineered cell. In some embodiments, the T cell can induce higher memory response. In some embodiments, the T cell can induce lower levels of inflammatory cytokines than a non-engineered cell, that is, the engineered cell does not cause a cytokine storm response.

In some embodiments, the engineered T cell is administered to an allogenic host, wherein the engineered T cell has no rejection by the host. In some embodiments, the allogenic T cell induces negligible or minimum rejection by the host. In some embodiments, the engineered T cell has fratricide resistance.

In some embodiments, the pharmaceutical composition is formulated for delivery to a subject. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249: 1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228: 190; During et al., 1989, Ann. Neurol. 25:351; Howard et al., 1989, J. Neurosurg. 71: 105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther. 1999, 6: 1438-47). Positively charged lipids such as N-[1-(2,3-dioleoyloxi)propyl]-N,N,N-trimethyl-amoniumm-ethylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication number WO2011/053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

In some embodiments, compositions in accordance with the present disclosure can be used for treatment of any of a variety of diseases, disorders, and/or conditions.

Methods of Treatment

Some aspects of the present invention provide methods of treating a subject in need, the method comprising administering to a subject in need an effective therapeutic amount of a pharmaceutical composition as described herein. More specifically, the methods of treatment comprise administering to a subject in need thereof one or more pharmaceutical compositions comprising a population of modified immune cells expressing a chimeric receptor (CAR) and having at least one edited gene, wherein the at least one edited gene provides fratricide resistance, enhances the function or reduces the immunosuppression or inhibition of the modified immune cell, and wherein expression of the at least one edited gene is either knocked out or knocked down. In some embodiments, the method of treatment is an autologous immune cell therapy. In other embodiments, the method of treatment is an allogeneic immune cell therapy.

In certain embodiments, the specificity of an immune cell is redirected to a marker expressed on the surface of a diseased or altered cell in a subject by genetically modifying the immune cell to express a chimeric antigen receptor contemplated herein. In some embodiments, the method of treatment comprises administering to a subject an immune cell as described herein, wherein the immune cell has been genetically modified to redirect its specificity to a marker expressed on a neoplastic cell. In some embodiments, the neoplasia is a B cell cancer; for example, a B cell cancer such as a lymphoma, leukemia, or a myeloma, for example, multiple myeloma. In some embodiments, the neoplasia is a solid tumor. In other embodiments, the neoplasia is a liquid tumor. In some embodiments, the neoplasia is a hematological cancer. In some embodiments, the hematological cancer is leukemia, myeloma, and/or lymphoma. In some cases, the leukemia comprises a pre-leukemia. In some cases, the leukemia is an acute leukemia. Acute leukemias include, for example, an acute myeloid leukemia (AML). Acute leukemias also include, for example, an acute lymphoid leukemia or an acute lymphocytic leukemia (ALL); ALL includes B-lineage ALL; T-lineage ALL; and T-cell acute lymphocytic leukemia (T-ALL).

Nonlimiting examples of neoplasia include T-cell acute lymphoblastic leukemia (T-ALL), mycosis fungoides (MF), Sézary syndrome (SS), Peripheral T/NK-cell lymphoma, Anaplastic large cell lymphoma ALK$^+$, Primary cutaneous T-cell lymphoma, T-cell large granular lymphocytic leukemia, Angioimmunoblastic T/NK-cell lymphoma, Hepatosplenic T-cell lymphoma, Primary cutaneous CD30$^+$ T lymphoproliferative disorders, Extranodal NK/T-cell lymphoma, Adult T-cell leukemia/lymphoma, T-cell prolymphocytic leukemia, Subcutaneous panniculitis-like T-cell lymphoma, Primary cutaneous gamma-delta T-cell lymphoma, Aggressive NK-cell leukemia, and Enteropathy-associated T-cell lymphoma. In some embodiments, the neoplasia is T-cell acute lymphoblastic leukemia (T-ALL). In some embodiments, the neoplasia is acute myelogenous leukemia (AML). Thus, some embodiments of the present disclosure provide a method of treating a neoplasia in a subject.

In some embodiments, the methods of treatment comprise administering to a subject having or having a propensity to develop a neoplasia (e.g., leukemia) an effective amount of a modified immune effector cell (e.g., CAR-T cell) that lacks or has reduced levels of functional T Cell Receptor Alpha Constant (TRAC), Cluster of Differentiation 33 (CD33), Cluster of Differentiation 3 (CD3), Cluster of Differentiation 5 (CD5), Cluster of Differentiation 7 (CD7), Cluster of Differentiation 52 (CD52), Cluster of Differentiation 123 (CD123), Programmed Cell Death 1 (PD-1), Beta-2 Microglobulin (B2M), Fas cell surface death receptor (FAS), Lymphocyte-activation gene 3 (LAG-3), Class II, Major Histocompatibility Complex, Transactivator (CIITA), T Cell Receptor Beta Constant 1 (TRBC1), T Cell Receptor Beta Constant 2 (TRBC2), or combinations thereof. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD123 and expresses a CD123 chimeric antigen receptor. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD5 and expresses a CD5 chimeric antigen receptor. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD7 and expresses a CD7 chimeric antigen receptor. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD33 and expresses a CD33 chimeric antigen receptor. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD3 and expresses a CD3 chimeric antigen receptor.

In some embodiments, a subject having or having a propensity to develop a neoplasia (e.g., T- or NK-cell malignancy) is administered an effective amount of a modified immune effector cell (e.g., CAR-T cell) that lacks or has reduced levels of functional TRAC. In some embodiments, a subject having or having a propensity to develop a neoplasia (e.g., T- or NK-cell malignancy) is administered an effective amount of a modified immune effector cell (e.g., CAR-T cell) that lacks or has reduced levels of functional B2M. In some embodiments, a subject having or having a propensity to develop a neoplasia (e.g., T- or NK-cell malignancy) is administered an effective amount of a modified immune effector cell (e.g., CAR-T cell) that lacks or has reduced levels of functional FAS. In some embodiments, a subject having or having a propensity to develop a neoplasia (e.g., T- or NK-cell malignancy) is administered an effective amount of a modified immune effector cell (e.g., CAR-T cell) that lacks or has reduced levels of functional LAG-3. In some embodiments, a subject having or having a propensity to develop a neoplasia (e.g., T- or NK-cell malignancy) is administered an effective amount of a modified immune effector cell (e.g., CAR-T cell) that lacks or has reduced levels of functional TRBC1 and/or TRBC2 In some embodiments, a subject having or having a propensity to develop a neoplasia (e.g., T- or NK-cell malignancy) is administered an effective amount of a modified immune effector cell (e.g., CAR-T cell) that lacks or has reduced levels of functional CIITA. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD52. In some embodiments, a subject having or having a propensity to develop a neoplasia (e.g., T- or NK-cell malignancy) is administered an effective amount of a modified immune effector cell (e.g., CAR-T cell) that lacks or has reduced levels of PD-1.

In some embodiments, a subject having or having a propensity to develop a neoplasia (e.g., leukemia) is administered an effective amount of a modified immune effector cell (e.g., CAR-T cell) or a population thereof that lacks or has reduced levels of CD123 and lacks or has reduced levels of TRAC, LAG-3, FAS, CD52, B2M, CIITA, TRBC1, TRBC2, and/or PD-1, or combinations thereof and expresses a CD123 chimeric antigen receptor containing. In some embodiments, a subject having or having a propensity to develop a neoplasia (e.g., leukemia) is administered an effective amount of a modified immune effector cell (e.g., CAR-T cell) that lacks or has reduced levels of CD5 and lacks or has reduced levels of TRAC, LAG-3, FAS, CD52, B2M, CIITA, TRBC1, TRBC2, and/or PD-1, or combinations thereof and expresses a CD5 chimeric antigen receptor. In some embodiments, a subject having or having a propensity to develop a neoplasia (e.g., leukemia) is administered an effective amount of a modified immune effector cell (e.g., CAR-T cell) that lacks or has reduced levels of CD7 and lacks or has reduced levels of TRAC, LAG-3, FAS, CD52, B2M, CIITA, TRBC1, TRBC2, and/or PD-1, or combinations thereof and expresses a CD7 chimeric antigen receptor. In some embodiments, a subject having or having a propensity to develop a neoplasia (e.g., leukemia) is administered an effective amount of a modified immune effector cell (e.g., CAR-T cell) that lacks or has reduced levels of CD33 and lacks or has reduced levels of TRAC, LAG-3, FAS, CD52, B2M, CIITA, TRBC1, TRBC2, and/or PD-1, or combinations thereof and expresses a CD33 chimeric antigen receptor. In some embodiments, a subject having or having a propensity to develop a neoplasia (e.g., leukemia) is administered an effective amount of a modified immune effector cell (e.g., CAR-T cell) that lacks or has reduced levels of CD3 and lacks or has reduced levels of TRAC, LAG-3, FAS, CD52, B2M, CIITA, TRBC1, TRBC2, and/or PD-1, or combinations thereof and expresses a CD3 chimeric antigen receptor.

In some embodiments of the methods of treating a neoplasia in a subject comprise administering to the subject an immune cell as described herein and one or more additional therapeutic agents. For example, the immune cell of the present invention can be co-administered with one or more additional modified immune cells or a population thereof. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD123 and expresses a CD123 chimeric antigen receptor and an effective amount of a modified immune effector cell (e.g., CAR-T cell) that lacks or has reduced levels of CD33 and expresses a CD33 chimeric antigen receptor. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD5 and expresses a CD5 chimeric antigen receptor and an effective amount of a modified immune effector cell (e.g., CAR-T cell) that lacks or has reduced levels of CD7 and expresses a CD7 chimeric antigen receptor. In some embodiments, any of the immune cells further comprises a mutation in one or more of CD3, CD5, CD7, CD33, CD123, TRAC, LAG-3, FAS, CIITA, TRBC1, TRBC2, CD52, B2M, and/or PD1, or a combination thereof. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD3 and expresses a CD3 chimeric antigen receptor and an effective amount of a modified immune effector cell (e.g., CAR-T cell) that lacks or has reduced levels of CD7 and expresses a CD7 chimeric antigen receptor. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD3 and expresses a CD3 chimeric antigen receptor and an effective amount of a modified immune effector cell (e.g., CAR-T cell) that lacks or has reduced levels of CD123 and expresses a CD123 chimeric antigen receptor.

In some embodiments, the immune cell of the present invention can be co-administered with a cytokine. In some embodiments, the cytokine is IL-2, IFN-α, IFN-γ, or a combination thereof. In some embodiments, the immune cell is co-administered with a chemotherapeutic agent. The chemotherapeutic can be cyclophosphamide, doxorubicin, vincristine, prednisone, or rituximab, or a combination thereof. Other chemotherapeutics include obinutuzumab, bendamustine, chlorambucil, cyclophosphamide, ibrutinib, methotrexate, cytarabine, dexamethasone, cisplatin, bortezomib, fludarabine, idelalisib, acalabrutinib, lenalidomide, venetoclax, cyclophosphamide, ifosfamide, etoposide, pentostatin, melphalan, carfilzomib, ixazomib, panobinostat, daratumumab, elotuzumab, thalidomide, lenalidomide, or pomalidomide, or a combination thereof. "Co-administered" refers to administering two or more therapeutic agents or pharmaceutical compositions during a course of treatment. Such co-administration can be simultaneous administration or sequential administration. Sequential administration of a later-administered therapeutic agent or pharmaceutical composition can occur at any time during the course of treatment after administration of the first pharmaceutical composition or therapeutic agent.

In some embodiments of the present invention, an administered immune cell proliferates in vivo and can persist in the subject for an extended period of time. Immune cells of the present invention, in some embodiments can mature into memory immune cells and remain in circulation within the subject, thereby generating a population of cells able to actively respond to recurrence of a diseased or altered cell expressing the marker recognized by the chimeric antigen receptor.

Provided herein is a method of treating a neoplasia or a liquid cancer with a modified immune cell (e.g., an immune cell obtained from a healthy subject, or a T cell such as, for example, a cytotoxic T cell, a regulatory T cell, or a T helper cell) produced by a method of expressing or introducing in an immune cell a nucleobase editor polypeptide and contacting the cell with two or more guide RNAs capable of targeting a nucleic acid molecule encoding at least one polypeptide, wherein a first polypeptide is Cbl Proto-Oncogene B (CBLB) and a second polypeptide is selected from the group consisting of a T Cell Receptor Alpha Constant (TRAC), beta-2 microglobulin (B2M), and programmed cell death protein 1 (PD1) polypeptide, wherein the nucleobase editor polypeptide comprises a nucleic acid programmable DNA binding protein (napDNAbp) and a cytidine deaminase. In one instance of such method, three guide RNAs are expressed in or contact the cell, each targeting a B2M, TRAC, PDCD1 or CBLB polynucleotide. In another instance of such method, four guide RNAs are expressed in or contact the cell, each targeting one of a B2M, TRAC, PDCD1, and CBLB polynucleotide. In one instance, two guide RNAs are expressed in or contact the cell, each targeting a B2M or TRAC polynucleotide. In another instance, three guide RNAs are expressed in or contact the cell, each targeting a B2M, TRAC, PDCD1 or CBLB polynucleotide. In another instance, four guide RNAs are expressed in or contact the cell, each targeting one of a B2M, TRAC, PDCD1, and CBLB polynucleotide. In another instance, three guide RNAs are expressed in or contact the cell, each targeting a B2M, TRAC, and PDCD1 polynucleotide. In another instance, the guide RNA targets a TRAC exon 4 splice acceptor site, B2M exon 1 splice donor site, or PDCD1 exon 1 splice donor site. In another embodiment, the method of producing the modified immune cell further comprises expressing in the cell a guide RNA that targets a cytotoxic T-lymphocyte associated protein 4 (CTLA4) polynucleotide.

Provided herein is a method of treating a neoplasia or a liquid cancer with a modified immune cell (e.g., an immune cell obtained from a healthy subject, or a T cell such as, for example, a cytotoxic T cell, a regulatory T cell, or a T helper cell) produced by a method of expressing or introducing in an immune cell a nucleobase editor polypeptide and contacting the cell with two or more guide RNAs capable of targeting a nucleic acid molecule encoding at least one polypeptide selected from the group consisting of a Cbl Proto-Oncogene B (CBLB), T Cell Receptor Alpha Constant (TRAC), beta-2 microglobulin (B2M), and programmed cell death protein 1 (PD1) polypeptide, wherein the nucleobase editor polypeptide comprises a nucleic acid programmable DNA binding protein (napDNAbp) and an adenosine deaminase. In one instance, two guide RNAs are expressed in or contact the cell, each targeting a B2M or TRAC polynucleotide. In another instance, three guide RNAs are expressed in or contact the cell, each targeting a B2M, TRAC, PDCD1 or CBLB polynucleotide. In another instance, four guide RNAs are expressed in or contact the cell, each targeting one of a B2M, TRAC, PDCD1, and CBLB polynucleotide. In another instance, three guide RNAs are expressed in or contact the cell, each targeting a B2M, TRAC, and PDCD1 polynucleotide. In another instance, the guide RNA targets a TRAC exon 4 splice acceptor site, B2M exon 1 splice donor site, or PDCD1 exon 1 splice donor site. In another embodiment, the method of producing the modified immune cell further comprises expressing in the cell a guide RNA that targets a cytotoxic T-lymphocyte associated protein 4 (CTLA4) polynucleotide.

Provided herein is a method of treating a neoplasia or a liquid cancer with a modified immune cell (e.g., an immune cell obtained from a healthy subject, or a T cell such as, for example, a cytotoxic T cell, a regulatory T cell, or a T helper cell) produced by a method of expressing or introducing in an immune cell a nucleobase editor polypeptide and contacting the cell with two or more guide RNAs capable of targeting a nucleic acid molecule encoding at least one polypeptide selected from the group consisting of a V-Set Immunoregulatory Receptor (VISTA), T Cell Immunoglobulin Mucin 3 (Tim-3), T Cell Immunoreceptor With Ig and ITIM Domains (TIGIT), Transforming Growth Factor Beta Receptor II (TGFbRII), Regulatory Factor X Associated Ankyrin Containing Protein (RFXANK), PVR Related Immunoglobulin Domain Containing (PVRIG), Lymphocyte-Activation Gene 3 (Lag3), Cytotoxic T-Lymphocyte Associated Protein 4 (CTLA-4), Chitinase 3 Like 1 (Chi3l1), Cluster of Differentiation 96 (CD96), B and T Lymphocyte Associated (BTLA), Tet Methylcytosine Dioxygenase 2 (TET2), Sprouty RTK Signaling Antagonist 1 (Spry1), Sprouty RTK Signaling Antagonist 2 (Spry2), Class II Major Histocompatibility Complex Transactivator (CIITA), Cluster of Differentiation 3 (CD3), Cluster of Differentiation 7 (CD7), Cluster of Differentiation 33 (CD33), Cluster of Differentiation 52 (CD52), Cluster of Differentiation 123 (CD123), T Cell Receptor Beta Constant 1 (TRBC1), T Cell Receptor Beta Constant 2 (TRBC2), Cytokine Inducible SH2 Containing Protein (CISH), Acetyl-CoA Acetyltransferase 1 (ACAT1), Cytochrome P450 Family 11 Subfamily A Member 1 (Cyp11a1), GATA Binding Protein 3 (GATA3), Nuclear Receptor Subfamily 4 Group A Member 1 (NR4A1), Nuclear Receptor Subfamily 4 Group A Member 2 (NR4A2), Nuclear Receptor Subfamily 4 Group A Member 3 (NR4A3), Methylation-Controlled J Protein (MCJ), Fas Cell Surface Death Receptor (FAS), and Selectin P Ligand/P-Selectin Glycoprotein Ligand-1 (SELPG/PSGL1) polypeptide, wherein the nucleobase editor polypeptide comprises a nucleic acid programmable DNA binding protein (napDNAbp) and an adenosine or cytidine deaminase. In one embodiment, the method of producing the cell further comprises contacting the cell with two or more guide RNAs capable of targeting a nucleic acid molecule encoding at least one polypeptide selected from the group consisting of a T Cell Receptor Alpha Constant (TRAC), beta-2 micro-globulin (B2M), and programmed cell death protein 1 (PD1) polypeptide. In another embodiment, the method of producing the modified immune cell further comprises expressing in the cell a guide RNA that targets a cytotoxic T-lympho-cyte associated protein 4 (CTLA4) polynucleotide.

Provided herein is a method of treating a neoplasia or a liquid cancer as described herein with modified immune cell (e.g., an immune cell obtained from a healthy subject, or a T cell such as, for example, a cytotoxic T cell, a regulatory T cell, or a T helper cell) having anti-neoplasia activity produced by a method comprising expressing in an immune cell isolated from a subject having a neoplasia one or more guide RNAs that target a polynucleotide encoding a poly-peptide selected from the group consisting of CBLB, PD1, CTLA4, TGFBR2, TIGIT, or a minor histocompatibility polypeptide and a nucleobase editor polypeptide comprising a nucleic acid programmable DNA binding protein (napD-NAbp) and a cytidine deaminase or an adenosine deaminase. In one instance, the guide RNAs each target a CBLB and a PDCD1 polynucleotide. In one instance, the guide RNAs each target a PDCD1 and a CTLA4 polynucleotide. In one instance, the guide RNAs each target a CBLB, PDCD1, and CTLA4 polynucleotide. In one instance, the guide RNAs each target a CBLB, PD1, and CTLA4 polynucleotide.

In any of such methods of producing a modified immune cell as described above, in one instance, the guide RNA targets a splice acceptor site or a splice donor site in a target polynucleotide. In any of such methods of producing a modified immune cell as described above, in one instance, the nucleobase editor polypeptide generates a stop codon in a target polynucleotide. In any of such methods of producing a modified immune cell as described above, in one instance, the nucleobase editor polypeptide generates a stop codon in a PDCD1 exon 2. In any of such methods of producing a modified immune cell as described above, in one instance, the nucleobase editor polypeptide further comprises expressing one or more Nuclear Localization Signals (NLS) such as, for example, a bipartite NLS, an N-terminal NLS, a C-terminal NLS, or one or more uracil glycosylase inhibi-tors.

In any of such methods of producing a modified immune cell as described above, in one instance, the napDNAbp is selected from the group consisting of Cas9, CasX, CasY, Cpf1, Cas12b/C2c1, Cas12c/C2c3, Cas12j/CasΦ, and BvCas12b or active fragments thereof. In any of such methods of producing a modified immune cell as described above, in one instance, the napDNAbp domain comprises a nuclease dead Cas9 (dCas9), a Cas9 nickase (nCas9), or a nuclease active Cas9. In any of such methods of producing a modified immune cell as described above, in one instance, the cytidine deaminase is *Petromyzon marinus* cytosine deaminase 1 (pmCDA1), or Activation-induced cytidine deaminase (AICDA) and the adenosine deaminase is TadA.

In any of such methods of producing a modified immune cell as described above, in one instance, the method further comprises expressing in the immune cell one or more guide RNAs that target a TIGIT polynucleotide, TGFBR2 poly-nucleotide, ZAP70 polynucleotide, NFATcl polynucleotide, and TET2 polynucleotide.

It will be understood that, in some instances, the modified immune cell to be administered to the subject comprises no detectable translocations.

Provided herein is a method of treating a neoplasia or a liquid cancer with a modified immune cell (e.g., an immune cell obtained from a healthy subject, or a T cell such as, for example, a cytotoxic T cell, a regulatory T cell, or a T helper cell) having reduced immunogenicity and increased anti-neoplasia activity, the modified immune cell comprising a mutation in a TRAC, B2M, CBLB, or PD1 polynucleotide, or in a combination thereof. In one instance, the modified immune cell comprises mutations in B2M and TRAC poly-nucleotides. In another instance, the modified immune cell comprises mutations in B2M, TRAC, and PDCD1 poly-nucleotides. In another instance, the modified immune cell comprises mutations in B2M, TRAC, and CBLB polynucle-otides. In another instance, the modified immune cell com-prises mutations in B2M, TRAC, CBLB, and PD1 poly-nucleotides. In another instance, the modified immune cell comprises a mutation in one or more polynucleotides encoding TIGIT, TGFBR2, ZAP70, NFATc1, or TET2. In another instance, the modified immune cell comprises a mutation in one or more polynucleotides encoding V-Set Immunoregulatory Receptor (VISTA), T Cell Immuno-globulin Mucin 3 (Tim-3), T Cell Immunoreceptor With Ig and ITIM Domains (TIGIT), Transforming Growth Factor Beta Receptor II (TGFbRII), Regulatory Factor X Associ-ated Ankyrin Containing Protein (RFXANK), PVR Related Immunoglobulin Domain Containing (PVRIG), Lympho-cyte-Activation Gene 3 (Lag3), Cytotoxic T-Lymphocyte Associated Protein 4 (CTLA-4), Chitinase 3 Like 1 (Chi311), Cluster of Differentiation 96 (CD96), B and T Lymphocyte Associated (BTLA), Tet Methylcytosine Dioxygenase 2 (TET2), Sprouty RTK Signaling Antagonist 1 (Spry1), Sprouty RTK Signaling Antagonist 2 (Spry2), Class II Major Histocompatibility Complex Transactivator (CIITA), Cluster of Differentiation 3 (CD3), Cluster of Differentiation 7 (CD7), Cluster of Differentiation 33 (CD33), Cluster of Differentiation 52 (CD52), Cluster of Differentiation 123 (CD123), T Cell Receptor Beta Constant 1 (TRBC1), T Cell Receptor Beta Constant 2 (TRBC2), Cytokine Inducible SH2 Containing Protein (CISH), Acetyl-CoA Acetyltransferase 1 (ACAT1), Cytochrome P450 Fam-ily 11 Subfamily A Member 1 (Cyp11a1), GATA Binding Protein 3 (GATA3), Nuclear Receptor Subfamily 4 Group A Member 1 (NR4A1), Nuclear Receptor Subfamily 4 Group A Member 2 (NR4A2), Nuclear Receptor Subfamily 4 Group A Member 3 (NR4A3), Methylation-Controlled J Protein (MCJ), Fas Cell Surface Death Receptor (FAS), or Selectin P Ligand/P-Selectin Glycoprotein Ligand-1 (SELPG/PSGL1). In another instance, the modified immune cell expresses a chimeric antigen receptor that comprises, for example, an extracellular domain having an affinity for a marker associated with neoplasia (e.g., a B cell maturation antigen (BCMA)).

Provided herein is a method of treating a neoplasia or a liquid cancer with a modified immune cell (e.g., an immune cell obtained from a healthy subject, or a T cell such as, for example, a cytotoxic T cell, a regulatory T cell, or a T helper cell) having reduced immunogenicity and increased anti-neoplasia activity, the modified immune cell comprising a mutation in one or more of a CD33, PD-1, CD52, TRAC polynucleotide, or in a combination thereof. In various embodiments, the modified immune cell comprises mutations in two or more of CD33, PD-1, CD52, TRAC, or a combination thereof. In various embodiments, the modified immune cell comprises mutations in three or more of CD33, PD-1, CD52, TRAC, or a combination thereof. In one instance, the modified immune cell comprises mutations in CD33, PD-1, CD52, and TRAC.

Provided herein is a method of treating a neoplasia or a liquid cancer with a modified immune cell (e.g., an immune cell obtained from a healthy subject, or a T cell such as, for example, a cytotoxic T cell, a regulatory T cell, or a T helper cell) having reduced immunogenicity and increased anti-neoplasia activity, the modified immune cell comprising a mutation in one or more of a CD3, PD-1, CD52, TRAC, CD7 polynucleotide, or a combination thereof. In various embodiments, the modified immune cell comprises mutations in two or more of CD3, PD-1, CD52, TRAC, CD7, or a combination thereof. In one instance, the modified immune cell comprises mutations in CD3 and CD7. In various embodiments, the modified immune cell comprises mutations in three or more of CD3, PD-1, CD52, TRAC, CD7, or a combination thereof. In one instance, the modified immune cell comprises mutations in CD3, PD-1, CD52, TRAC, and CD7.

Provided herein is a method of treating a neoplasia or a liquid cancer with a modified immune cell (e.g., an immune cell obtained from a healthy subject, or a T cell such as, for example, a cytotoxic T cell, a regulatory T cell, or a T helper cell) produced by a method of expressing or introducing in an immune cell a nucleobase editor polypeptide; two or more guide RNAs capable of targeting a nucleic acid molecule encoding at least one polypeptide, selected from the group consisting of beta-2 microglobulin (B2M) and programmed cell death protein 1 (PD1) polypeptide; a Cas12 polypeptide; a guide RNA capable of targeting a nucleic acid molecule encoding TRAC; and a DNA donor template encoding a chimeric antigen receptor (CAR) or T cell receptor, wherein the nucleobase editor polypeptide comprises a nucleic acid programmable DNA binding protein (napDNAbp) and a cytidine deaminase.

Provided herein is a method of treating a neoplasia or a liquid cancer with a modified immune cell (e.g., an immune cell obtained from a healthy subject, or a T cell such as, for example, a cytotoxic T cell, a regulatory T cell, or a T helper cell) having reduced immunogenicity and increased anti-neoplasia activity, the modified immune cell comprising a mutation in one or more of a B2M or PD1 polynucleotide, an insertion of a nucleic acid encoding a chimeric antigen receptor (CAR) at the TRAC locus, and expressing the CAR on the cell surface of the immune cell.

In some embodiments of the present invention, provided herein is a method of treating a liquid cancer in a subject in need thereof, comprising administering to the subject in need an effective therapeutic amount of a pharmaceutical composition as described herein. A liquid cancer to be treated by such methods include, but are not limited to, a lymphoma, a leukemia, a myeloma, or a combination thereof.

In one instance, provided herein is a method of treating a liquid cancer in a subject in need thereof, comprising administering to the subject in need an effective therapeutic amount of a pharmaceutical composition as described herein, wherein the liquid cancer comprises a lymphoma. A liquid lymphoma to be treated using the methods described herein includes, but is not limited to, malignant plasma cell neoplasm, Hodgkin's lymphoma; nodular lymphocyte predominant Hodgkin's lymphoma; polycythemia vera, Hodgkin lymphoma; small lymphocytic lymphoma (SLL); diffuse large B-cell lymphoma; immunoblastic large cell lymphoma; precursor B-lymphoblastic lymphoma; mantle cell lymphoma; marginal zone lymphoma; mycosis fungoides; anaplastic large cell lymphoma; Sézary syndrome; precursor T-lymphoblastic lymphoma; and B-cell lymphoma unclassified with features intermediate between diffuse large B-cell lymphoma and classical Hodgkin lymphoma; B-cell non-Hodgkin's lymphoma (NHL); follicular lymphoma; Burkitt's lymphoma; Burkitt-like lymphoma; marginal zone lymphoma; mantle cell lymphoma; diffuse large B-cell lymphoma (DLBCL), primary mediastinal B-cell lymphoma; large cell lymphoma; precursor B-lymphoblastic lymphoma; B-cell lymphoma unclassified with features intermediate between diffuse large B-cell lymphoma and Burkitt's lymphoma; marginal zone lymphoma; mucosa-associated lymphatic tissue lymphoma; small cell lymphocytic lymphoma; mantle cell lymphoma; primary mediastinal (thymic) large B-cell lymphoma; lymphoplasmacytic lymphoma (such as Waldenstrom's macroglobulinemia); nodal marginal zone B cell lymphoma; splenic marginal zone lymphoma; intravascular large B-cell lymphoma; primary effusion lymphoma; lymphomatoid granulomatosis; T cell/histiocyte-rich large B-cell lymphoma; primary central nervous system lymphoma; primary cutaneous diffuse large B-cell lymphoma (leg type); EBV positive diffuse large B-cell lymphoma of the elderly; diffuse large B-cell lymphoma associated with inflammation; intravascular large B-cell lymphoma; ALK-positive large B-cell lymphoma; plasmablastic lymphoma; large B-cell lymphoma arising in HHV8-associated multicentric Castleman disease; mediastinal (thymic) large B cell lymphoma; intravascular large B cell lymphoma; primary effusion lymphoma; nasal type, enteropathy-type T cell lymphoma; hepatosplenic T cell lymphoma; blastic NK cell lymphoma; primary cutaneous anaplastic large cell lymphoma; lymphomatoid papulosis; angioimmunoblastic T cell lymphoma; peripheral T cell lymphoma; unspecified, anaplastic large cell lymphoma; classical Hodgkin lymphomas (nodular sclerosis, mixed cellularity, lymphocyte-rich, lymphocyte depleted or not depleted); nodular lymphocyte-predominant Hodgkin lymphoma; adult T cell lymphoma; a B-Cell Lymphoma-DLBCL, a B-Cell Lymphoma-DLBCL-germinal center-like; a B-Cell Lymphoma-DLBCL-activated B-cell-like; Non-Hodgkin lymphoma; primary central nervous system (CNS) lymphoma; T-cell lymphoma; peripheral T cell lymphomas, cutaneous T-cell lymphoma (CTCL); anaplastic large cell lymphoma (ALCL); AIDS-related lymphoma; enteropathy-type T cell lymphoma; hepatosplenic T cell lymphoma; blastic NK cell lymphoma; primary cutaneous anaplastic large cell lymphoma; lymphomatoid papulosis, angioimmunoblastic T cell lymphoma; peripheral T cell lymphoma; unspecified, anaplastic large cell lymphoma; classical Hodgkin lymphomas (nodular sclerosis, mixed cellularity, lymphocyte-rich, lymphocyte depleted or not depleted); and nodular lymphocyte-predominant Hodgkin lymphoma; other lymphomas; and a combination of such lymphomas.

In one instance, provided herein is a method of treating a liquid cancer in a subject in need thereof, comprising administering to the subject in need an effective therapeutic amount of a pharmaceutical composition as described herein, wherein the liquid cancer comprises a leukemia. In some cases, the leukemia comprises a pre-leukemia. Pre-leukemias include, for example, myelodysplastic syndrome (MDS). In some cases, the leukemia is an acute leukemia. Acute leukemias include, for example, an acute myeloid leukemia (AML). Acute leukemias also include, for example, an acute lymphoid leukemia or an acute lympho-cytic leukemia (ALL); ALL includes B-lineage ALL; T-lin-eage ALL; and T-cell acute lymphocytic leukemia (T-ALL). Other leukemias to be treated with the methods described herein include, but are not limited to, hairy cell leukemia (HCL); chronic myeloid leukemia (CIVIL); chronic myelo-monocytic leukemia (CMML); chronic lymphocytic leuke-mia (CLL); B-cell prolymphocytic leukemia, myeloid leu-kemia; Burkitt's leukemia; T cell prolymphocytic leukemia; T cell large granular lymphocytic leukemia; aggressive natural killer (NK) cell leukemia; adult T cell leukemia (ATL); acute promyeloid leukemia (APML); prolympho-cytic leukemia (PLL); erythroblastic leukemia; acute mega-karyoblastic leukemia; large granular lymphocytic leukemia (LGF); chronic myelogenous leukemia (CML); other leu-kemias; and a combination of such leukemias.

In one instance, provided herein is a method of treating a liquid cancer in a subject in need thereof, comprising administering to the subject in need an effective therapeutic amount of a pharmaceutical composition as described herein, wherein the liquid cancer comprises a myeloma. A myeloma to be treated using the methods described herein includes, but is not limited to, multiple myeloma; smolder-ing multiple myeloma; plasma cell myeloma; non-secretory myeloma, IgD myeloma; osteosclerotic myeloma; other myelomas; and a combination of such myelomas.

In one instance, provided herein is a method of treating a liquid cancer in a subject in need thereof, comprising administering to the subject in need an effective therapeutic amount of a pharmaceutical composition as described herein, wherein the liquid cancer comprises a Kahler's disease; Myelomatosis; plasmacytoma; solitary plasmacy-toma of bone; extramedullary plasmacytomamycosis fun-goides/Sezary Syndrome; primary cutaneous CD30-positive T cell lymphoproliferative disorders; hyper eosinophilia; chronic eosinophilia; and other hematopoietic cells related cancer.

In one embodiment, a subject is administered at least $0.1\times10^5$ cells, at least $0.5\times10^5$ cells, at least $1\times10^5$ cells, at least $5\times10^5$ cells, at least $1\times10^6$ cells, at least $0.5\times10^7$ cells, at least $1\times10^7$ cells, at least $0.5\times10^8$ cells, at least $1\times10^8$ cells, at least $0.5\times10^9$ cells, at least $1\times10^9$ cells, at least $2\times10^9$ cells, at least $3\times10^9$ cells, at least $4\times10^9$ cells, at least $5\times10^9$ cells, or at least $1\times10^{10}$ cells. In particular embodi-ments, about $1\times10^7$ cells to about $1\times10^9$ cells, about $2\times10^7$ cells to about $0.9\times10^9$ cells, about $3\times10^7$ cells to about $0.8\times10^9$ cells, about $4\times10^7$ cells to about $0.7\times10^9$ cells, about $5\times10^7$ cells to about $0.6\times10^9$ cells, or about $5\times10^7$ cells to about $0.5\times10^9$ cells are administered to the subject.

In one embodiment, a subject is administered at least $0.1\times10^4$ cells/kg of bodyweight, at least $0.5\times10^4$ cells/kg of bodyweight, at least $1\times10^4$ cells/kg of bodyweight, at least $5\times10^4$ cells/kg of bodyweight, at least $1\times10^5$ cells/kg of bodyweight, at least $0.5\times10^6$ cells/kg of bodyweight, at least $1\times10^6$ cells/kg of bodyweight, at least $0.5\times10^7$ cells/kg of bodyweight, at least $1\times10^7$ cells/kg of bodyweight, at least $0.5\times10^8$ cells/kg of bodyweight, at least $1\times10^8$ cells/kg of bodyweight, at least $2\times10^8$ cells/kg of bodyweight, at least $3\times10^8$ cells/kg of bodyweight, at least $4\times10^8$ cells/kg of bodyweight, at least $5\times10^8$ cells/kg of bodyweight, or at least $1\times10^9$ cells/kg of bodyweight. In particular embodi-ments, about $1\times10^6$ cells/kg of bodyweight to about $1\times10^8$ cells/kg of bodyweight, about $2\times10^6$ T cells/kg of body-weight to about $0.9\times10^8$ cells/kg of bodyweight, about $3\times10^6$ cells/kg of bodyweight to about $0.8\times10^8$ cells/kg of bodyweight, about $4\times10^6$ cells/kg of bodyweight to about $0.7\times10^8$ cells/kg of bodyweight, about $5\times10^6$ cells/kg of bodyweight to about $0.6\times10^8$ cells/kg of bodyweight, or about $5\times10^6$ cells/kg of bodyweight to about $0.5\times10^8$ cells/ kg of bodyweight are administered to the subject.

One of ordinary skill in the art would recognize that multiple administrations of the pharmaceutical compositions contemplated in particular embodiments may be required to affect the desired therapy. For example, a composition may be administered to the subject 1, 2, 3, 4, 5, 6, 7, 8, 9, or 10 or more times over a span of 1 week, 2 weeks, 3 weeks, 1 month, 2 months, 3 months, 4 months, 5 months, 6 months, 1 year, 2 years, 5, years, 10 years, or more. In any of such methods, the methods may comprise administering to the subject an effective amount of the modified immune cells and the method increases or reduces an immune response. In any of such methods, the methods may comprise adminis-tering one or more doses of an effective amount of the modified immune cells per day. In any of such methods, the methods may comprise administering two or more doses of an effective amount of the modified immune cells per day. In any of such methods, the methods may comprise adminis-tering three or more doses of an effective amount of the modified immune cells per day. In any of such methods, the methods may comprise administering one or more doses of an effective amount of the modified immune cells per week. In any of such methods, the methods may comprise admin-istering two or more doses of an effective amount of the modified immune cells per week. In any of such methods, the methods may comprise administering three or more doses of an effective amount of the modified immune cells per week. In any of such methods, the methods may com-prise administering one or more doses of an effective amount of the modified immune cells per month. In any of such methods, the methods may comprise administering two or more doses of an effective amount of the modified immune cells per month. In any of such methods, the methods may comprise administering three or more doses of an effective amount of the modified immune cells per month.

In certain embodiments, it may be desirable to administer activated the pharmaceutical composition to the subject and then subsequently redraw blood (or have an apheresis per-formed), activate T cells therefrom, and reinfuse the patient with these activated and expanded T cells. This process can be carried out multiple times every few weeks. In certain embodiments, T cells can be activated from blood draws of from 10 cc to 400 cc. In certain embodiments, T cells are activated from blood draws of 20 cc, 30 cc, 40 cc, 50 cc, 60 cc, 70 cc, 80 cc, 90 cc, 100 cc, 150 cc, 200 cc, 250 cc, 300 cc, 350 cc, or 400 cc or more.

Administration of the pharmaceutical compositions con-templated herein may be carried out using conventional techniques including, but not limited to, infusion, transfu-sion, or parenterally. In some embodiments, parenteral administration includes infusing or injecting intravascularly, intravenously, intramuscularly, intraarterially, intrathecally, intratumorally, intradermally, intraperitoneally, transtrache-ally, subcutaneously, subcuticularly, intraarticularly, subcap-sularly, subarachnoidly and intrastemally.

The response in individual subjects can be characterized as a complete response, a partial response, stable disease, and progressive disease. In some embodiments, the response is complete response (CR). Complete response can be defined as disappearance of all circulating tumor cells (CTC) or a mononuclear blood cells (MNBC) i.e., any pathological lymph nodes (whether target or non-target) must have reduction in short axis to <10 mm. In some examples (e.g., AML), complete response can be defined as the following: bone marrow blasts <5%; absence of blasts with Auer rods; absence of extramedullary disease; absolute neutrophil count >$1.0 \times 10^9$/L (1000/µL); platelet count >$100 \times 10^9$/L (100 000/µL); and independence of red cell transfusions. In certain embodiments, the response is a CR with Incomplete Recovery (CRi). CR with Incomplete Recovery, in some examples (e.g., AML), can be defined to include all CR criteria except for residual neutropenia (<$1.0 \times 10^9$/L [1000/ µL]) or thrombocytopenia (<$100 \times 10^9$/L [100 000/µL]). In certain embodiments, the response is a morphologic leukemia free state. Morphologic leukemia free state, in some examples (e.g., AML), can be defined to include bone marrow blasts <5%; absence of blasts with Auer rods; absence of extramedullary disease; and no hematologic recovery required. In certain embodiments, the response is a partial response (PR). Partial response can be defined to mean at least 30% decrease in the sum of diameters of circulating tumor cells (CTC) or a mononuclear blood cells (MNBC), taking as reference the baseline sum diameters. In some examples (e.g., AML), partial response can be defined to include all hematologic criteria of CR; decrease of bone marrow blast percentage to 5% to 25%; and decrease of pretreatment bone marrow blast percentage by at least 50%. In certain embodiments, the response is a morphologic leukemia free state. Morphologic leukemia free state, in some examples (e.g., AML), can be defined to include bone marrow blasts <5%; absence of blasts with Auer rods; absence of extramedullary disease; and no hematologic recovery required. In certain embodiments, the response is a relapse.

Relapse, in some examples (e.g., AML), can be defined to include bone marrow blasts <5%; absence of blasts with Auer rods; absence of extramedullary disease; and no hematologic recovery required. In some embodiments, the response is progressive disease (PD). Progressive disease can be defined as at least a 20% increase in the number of circulating tumor cells (CTC) or a mononuclear blood cells (MNBC), taking as reference the smallest number on study (this includes the baseline number if that is the smallest) and an absolute increase of at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, or at least 100 or more circulating tumor cells (CTC) or a mononuclear blood cells (MNBC).

The appearance of one or more new lesions can also be considered as progression. In some embodiments, the disease can be stable disease (SD). Stable disease can be characterized by neither sufficient decrease in liquid cancer cell number to qualify for PR nor sufficient increase to qualify for PD, taking as reference the smallest number of CTCs and/or MNBCs while on study. In certain embodiments, the response is a pathological complete response. A pathological complete response, e.g., as determined by a pathologist following examination of tissue removed at the time of surgery or biopsy, generally refers to an absence of histological evidence of invasive and/or non-invasive liquid cancer cells in the surgical specimen.

In some embodiments, the pharmaceutical composition is administered two or three times a week. In another embodiment, the pharmaceutical composition is administered two times a week. In another embodiment, the pharmaceutical composition is administered once every 2 or 3 weeks. In another embodiment, the pharmaceutical composition is administered once every 1 or 2 weeks. In another embodiment, the pharmaceutical composition is administered on days 1, 4, 8, and 11 of a 21-day cycle. In another embodiment, the pharmaceutical composition is administered on days 1, 8, and 15 of a 28-day cycle.

In some embodiments, the amount of the compound administered is about 0.5-30 mg per kilogram body weight of the human subject. In another embodiment, the amount of the compound administered is about 0.5-20 mg per kilogram body weight of the human subject. In another embodiment, the amount of the compound administered is about 0.5-10 mg per kilogram body weight of the human subject. In another embodiment, the amount of the compound administered is about 0.04 mg, about 0.08 mg, about 0.16 mg, about 0.32 mg, about 0.64 mg, about 1.25 mg, about 1.28 mg, about 1.92 mg, about 2.5 mg, about 3.56 mg, about 3.75 mg, about 5.0 mg, about 7.12 mg, about 7.5 mg, about 10 mg, about 14.24 mg, about 15 mg, about 20 mg, or about 30 mg per kilogram body weight of the human subject. In another embodiment, the amount of the compound administered is about 1.92 mg, about 3.75 mg, about 7.5 mg, about 15.0 mg, or about 30.0 mg per kilogram body weight of the human subject and the compound is administered two times a week. In another embodiment, the amount of the compound administered is about 1.28 mg, about 2.56 mg, about 5.0 mg, about 10 mg, or about 20 mg per kilogram body weight of the human subject and the compound is administered two times a week. In another embodiment, the amount of the compound administered is about 1.92 mg, about 3.75 mg, about 7.5 mg, about 15.0 mg, or about 30.0 mg per kilogram body weight of the human subject and the compound is administered once a week. In another embodiment, the amount of the compound administered is about 1.28 mg, about 2.56 mg, about 5.0 mg, about 10 mg, or about 20 mg per kilogram body weight of the human subject and the compound is administered once a week. In another embodiment, the amount of the compound administered is about 1.92 mg, about 3.75 mg, about 7.5 mg, about 15.0 mg, or about 30.0 mg per kilogram body weight of the human subject and the compound is administered once a day three, five or seven times in a seven day period. In another embodiment, the compound is administered intravenously once a day, seven times in a seven day period. In another embodiment, the amount of the compound administered is about 1.28 mg, about 2.56 mg, about 5.0 mg, about 10 mg, or about 20 mg per kilogram body weight of the human subject and the compound is administered once a day three, five or seven times in a seven day period. In another embodiment, the compound is administered intravenously once a day, seven times in a seven day period.

In some embodiments, the compound is administered over a period of 0.25 h, 0.5 h, 1 h, 2 h, 3 h, 4 h, 5 h, 6 h, 7 h, 8 h, 9 h, 10 h, 11 h, or 12 h. In another embodiment, the compound is administered over a period of 0.25-2 h. In another embodiment, the compound is gradually administered over a period of 1 h. In another embodiment, the compound is gradually administered over a period of 2 h.

In some embodiments, the in vivo circulating half-life of the compound is about 1 h, 2 h, 3 h, 4 h, 5 h, 6 h, 7 h, 8 h, 9 h, 10 h or 12 h. In another embodiment, the in vivo circulating half-life of the compound is about 4 h. In another embodiment, in vivo circulating the half-life of the compound is about 6 h. In some embodiments, the biological tissue half-life of the compound is about 1 h, 2 h, 3 h, 4 h, 5 h, 6 h, 7 h, 8 h, 9 h, 10 h or 12 h. In another embodiment, the biological tissue half-life of the compound is about 10 h.

In some embodiments, the treatment results in about 95%, about 90%, about 85%, about 80%, about 75%, about 70%, about 65%, about 60%, about 55%, about 50%, about 45%, about 40%, about 35%, about 30%, about 25%, about 20%, about 15%, about 10%, or about 5% reduction in the number of liquid cancer cells within a period of 1 month after treatment initiation. In another embodiment, the treatment results in at least about 60%, at least about 65%, at least about 70%, at least about 75%, at least about 80%, at least about 85%, at least about 90%, or at least about 95% reduction in the number of liquid cancer cells within a period of 1 month after treatment initiation. In another embodiment, the treatment results in about 95%, about 90%, about 85%, about 80%, about 75%, about 70%, about 65%, about 60%, about 55%, about 50%, about 45%, about 40%, about 35%, about 30%, about 25%, about 20%, about 15%, about 10%, or about 5% reduction in the number of liquid cancer cells within a period of 1 year after treatment initiation. In another embodiment, the treatment results in at least about 60%, at least about 65%, at least about 70%, at least about 75%, at least about 80%, at least about 85%, at least about 90%, or at least about 95% reduction in the number of liquid cancer cells within a period of 1 year after treatment initiation. In another embodiment, the treatment results in about 95%, about 90%, about 85%, about 80%, about 75%, about 70%, about 65%, about 60%, about 55%, about 50%, about 45%, about 40%, about 35%, about 30%, about 25%, about 20%, about 15%, about 10%, or about 5% reduction the number of liquid cancer cells within a period of 6 months after treatment initiation. In another embodiment, the treatment results in at least about 60%, at least about 65%, at least about 70%, at least about 75%, at least about 80%, at least about 85%, at least about 90%, or at least about 95% reduction in the number of liquid cancer cells within a period of 6 months after treatment initiation. In another embodiment, the treatment results in about 95%, about 90%, about 85%, about 80%, about 75%, about 70%, about 65%, about 60%, about 55%, about 50%, about 45%, about 40%, about 35%, about 30%, about 25%, about 20%, about 15%, about 10%, or about 5% reduction in the number of liquid cancer cells within a period of 3 months after treatment initiation. In another embodiment, the treatment results in at least about 60%, at least about 65%, at least about 70%, at least about 75%, at least about 80%, at least about 85%, at least about 90%, or at least about 95% reduction in the number of liquid cancer cells within a period of 3 months after treatment initiation.

In some embodiments, the treatment results in an increased survival time of the human subject as compared to the expected survival time of the human subject if the human subject was not treated with the compound. In another embodiment, the increase in the survival time of the human subject is at least 30 days. In another embodiment, the increase in the survival time of the human subject is at least 3 months. In another embodiment, the increase in the survival time of the human subject is at least 6 months. In another embodiment, the increase in the survival time of the human subject is at least 1 year.

In some embodiments, the human subject is refractory and/or intolerant to one or more other treatment of the liquid cancer. In another embodiment, the human subject has had at least one unsuccessful prior treatment and/or therapy of the liquid cancer. In some embodiments, the human subject to be treated with the described methods is a child (e.g., 0-18 years of age). In other embodiments, the human subject to be treated with the described methods is an adult (e.g., 18+ years of age). Kits The invention provides kits for the treatment of a neoplasia in a subject. In some embodiments, the kit is for the treatment of a solid tumor. In other embodiments, the kit is for the treatment of a liquid tumor. In some embodiments, the kit is for the treatment of a hematological cancer. In some embodiments, the hematological cancer is a B cell cancer. In some embodiments, the hematological cancer is leukemia, myeloma, and/or lymphoma. In some embodiments, the kit is for the treatment of a neoplasia selected from the group consisting of T-cell acute lymphoblastic leukemia (T-ALL), mycosis fungoides (MF), Sézary syndrome (SS), Peripheral T/NK-cell lymphoma, Anaplastic large cell lymphoma ALK+, Primary cutaneous T-cell lymphoma, T-cell large granular lymphocytic leukemia, Angioimmunoblastic T/NK-cell lymphoma, Hepatosplenic T-cell lymphoma, Primary cutaneous CD30+lymphoproliferative disorders, Extranodal NK/T-cell lymphoma, Adult T-cell leukemia/lymphoma, T-cell prolymphocytic leukemia, Subcutaneous panniculitis-like T-cell lymphoma, Primary cutaneous gamma-delta T-cell lymphoma, Aggressive NK-cell leukemia, and Enteropathy-associated T-cell lymphoma. In some embodiments, the kit is for the treatment of T-cell acute lymphoblastic leukemia (T-ALL). In some embodiments, the kit is for the treatment of acute myelogenous leukemia (AML). In some embodiments, the kit is for the treatment of a human subject.

In some embodiments, the kit comprises any of the chimeric antigen receptors as provided herein. In some embodiments, the kit comprises a nucleic acid encoding any of the chimeric antigen receptors as provided herein. In some embodiments, the kit comprises any of the modified immune cells as provided herein. In some embodiments, the kit includes a modified immune cell expressing a CD3 CAR, CD5 CAR, a CD7 CAR, a CD33 CAR and/or a CD123 CAR. In some embodiments, any of the immune cells further comprises a mutation in one or more of CD3, CD5, CD7, CD33, CD123, TRAC, LAG-3, FAS, CIITA, TRBC1, TRBC2, CD52, B2M, and/or PDT, or a combination thereof.

In some embodiments, the kit includes a population of any of the modified immune cells provided herein. In some embodiments, the kit comprises any of the pharmaceutical compositions as provided herein. In some embodiments, the kit includes a population of CD123 modified immune cells or a pharmaceutical composition comprising a CD123 modified immune cell or population of modified immune cells. In some embodiments, the kit includes a population of CD5 modified immune cells or a pharmaceutical composition comprising a CD5 modified immune cell or population of modified immune cells. In some embodiments, the kit includes a population of CD7 modified immune cells or a pharmaceutical composition comprising a CD7 modified immune cell or population of modified immune cells. In some embodiments, the kit includes a population of CD33 modified immune cells or a pharmaceutical composition comprising a CD33 modified immune cell or population of modified immune cells. In some embodiments, the kit includes a population of CD3 modified immune cells or a pharmaceutical composition comprising a CD3 modified immune cell or population of modified immune cells.

In some embodiments, the kit further includes a base editor polypeptide or a polynucleotide encoding a base editor polypeptide, wherein the base editor polypeptide comprises a nucleic acid programmable DNA binding protein (napDNAbp) and a deaminase. In some embodiments, the napDNAbp is Cas9 or Cas12. In some embodiments, the polynucleotide encoding the base editor is a mRNA sequence. In some embodiments, the deaminase is a cytidine deaminase or an adenosine deaminase.

The invention provides kits comprising a nucleic acid construct comprising a nucleotide sequence encoding a cytidine or adenosine deaminase nucleobase editor at least one guide RNA, each guide RNA having a nucleic acid sequence at least 85% complementary to a nucleic acid sequence of gene encoding TRAC, LAG-3, FAS, CIITA, TRBC1, TRBC2, CD52, B2M, PD1, CBLB, and/or CTLA4. In some embodiments, the nucleotide sequence encoding the cytidine or adenosine deaminase comprises a heterologous promoter that drives expression of the cytidine or adenosine deaminase nucleobase editor.

Some aspects of this disclosure provide kits comprising a nucleic acid construct, comprising a nucleotide encoding a nucleobase editor and a guide RNA. In some embodiments, the nucleic acid construct comprises a heterologous promoter that drives expression of the nucleobase editor. In some embodiments, this disclosure provides kits comprising a nucleic acid construct, comprising (a) a nucleotide sequence encoding (a) a Cas9 domain fused to a cytidine or adenosine deaminase as provided herein; and (b) a heterologous promoter that drives expression of the sequence of (a). In some embodiments, the Cas9 domain is fused to a cytidine deaminase. In some embodiments, the Cas9 domain is fused to an adenosine deaminase.

In some embodiments, the kit comprises a cytidine deaminase nucleobase editor and a guide RNA. In some embodiments, the kit comprises an adenosine deaminase nucleobase editor and a guide RNA. In some embodiments, the kit further one or more guide nucleic acid sequences. In some embodiments, the one of more guide nucleic acid sequences target CD3, CD5, CD7, CD33, or CD123. In some embodiments, the one or more guide nucleic acid sequences target each one of CD3, CD5, CD7, CD33, CD123, TRAC, LAG-3, FAS, CIITA, TRBC1, TRBC2, CD52, B2M, and/or PD1 In some embodiments, the guide RNA has a nucleic acid sequence that is at least 85% complementary to a nucleic acid sequence of a gene encoding CD5. In some embodiments, the kit comprises a nucleobase editor and a CD5 guide RNA. In some embodiments, the guide RNA has a nucleic acid sequence that is at least 85% complementary to a nucleic acid sequence of a gene encoding CD7. In some embodiments, the kit comprises a nucleobase editor and a CD7 guide RNA. In some embodiments, the guide RNA has a nucleic acid sequence that is at least 85% complementary to a nucleic acid sequence of a gene encoding CD33. In some embodiments, the kit comprises a nucleobase editor and a CD33 guide RNA. In some embodiments, the guide RNA has a nucleic acid sequence that is at least 85% complementary to a nucleic acid sequence of a gene encoding CD3. In some embodiments, the kit comprises a nucleobase editor and a CD3 guide RNA. In some embodiments, the guide RNA has a nucleic acid sequence that is at least 85% complementary to a nucleic acid sequence of a gene encoding CD123. In some embodiments, the kit comprises a cytidine deaminase nucleobase editor and a CD123 guide RNA. In some embodiments, the kit may further include one or more additional guide RNAs, each guide RNA having a nucleic acid sequence at least 85% complementary to a nucleic acid sequence of gene encoding TRAC, LAG-3, FAS, PD1, B2M, CIITA, TRBC1, TRBC2, and/or CD52.

The neoplasia treatment kits may further comprise written instructions for using the modified immune cells in the treatment of the neoplasia. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: Disruption of Splice Sites and Introduction of Stop Codons in Genes Expressed in Immune Cells A nucleobase editor, BE4, was used to disrupt splice sites and insert stop codons into a subset of genes expressed in immune cells. A plasmid construct, pCMV_BE4max, encodes BE4, which comprises an APOBEC-1 cytidine deaminase domain having cytidine deaminase activity, a Cas9 domain comprising a D10A mutation and having nickase activity, and two uracil DNA glycosylase inhibitor (UGI) domains. UGI is an 83-amino acid residue protein derived from *Bacillus subtilis* bacteriophage PBS1 that potently blocks to edit the splice sites of certain genes expressed in immune cells. BE4 further comprises N-terminal and C-terminal nuclear localization signals (NLSs).

```
>pCMV_BE4max
ATATGCCAAGTACGCCCCCTATTGACGTCAATGAC

GGTAAATGGCCCGCCTGGCATTATGCCCAGTACAT

GACCTTATGGGACTTTCCTACTTGGCAGTACATCT
```

565

-continued

ACGTATTAGTCATCGCTATTACCATGGTGATGCGG

TTTTGGCAGTACATCAATGGGCGTGGATAGCGGTT

TGACTCACGGGGATTTCCAAGTCTCCACCCCATTG

ACGTCAATGGGAGTTTGTTTTGGCACCAAAATCAA

CGGGACTTTCCAAAATGTCGTAACAACTCCGCCCC

ATTGACGCAAATGGGCGGTAGGCGTGTACGGTGGG

AGGTCTATATAAGCAGAGCTGGTTTAGTGAACCGT

CAGATCCGCTAGAGATCCGCGGCCGCTAATACGAC

TCACTATAGGGAGAGCCGCCACCATGAAACGGACA

GCCGACGGAAGCGAGTTCGAGTCACCAAAGAAGAA

GCGGAAAGTCTCCTCAGAGACTGGGCCTGTCGCCG

TCGATCCAACCCTGCGCCGCCGGATTGAACCTCAC

GAGTTTGAAGTGTTCTTTGACCCCCGGGAGCTGAG

AAAGGAGACATGCCTGCTGTACGAGATCAACTGGG

GAGGCAGGCACTCCATCTGGAGGCACACCTCTCAG

AACACAAATAAGCACGTGGAGGTGAACTTCATCGA

GAAGTTTACCACAGAGCGGTACTTCTGCCCCAATA

CCAGATGTAGCATCACATGGTTTCTGAGCTGGTCC

CCTTGCGGAGAGTGTAGCAGGGCCATCACCGAGTT

CCTGTCCAGATATCCACACGTGACACTGTTTATCT

ACATCGCCAGGCTGTATCACCACGCAGACCCAAGG

AATAGGCAGGGCCTGCGCGATCTGATCAGCTCCGG

CGTGACCATCCAGATCATGACAGAGCAGGAGTCCG

GCTACTGCTGGCGGAACTTCGTGAATTATTCTCCT

AGCAACGAGGCCCACTGGCCTAGGTACCCACACCT

GTGGGTGCGCCTGTACGTGCTGGAGCTGTATTGCA

TCATCCTGGGCCTGCCCCCTTGTCTGAATATCCTG

CGGAGAAAGCAGCCCCAGCTGACCTTCTTTACAAT

CGCCCTGCAGTCTTGTCACTATCAGAGGCTGCCAC

CCCACATCCTGTGGGCCACAGGCCTGAAGTCTGGA

GGATCTAGCGGAGGATCCTCTGGCAGCGAGACACC

AGGAACAAGCGAGTCAGCAACACCAGAGAGCAGTG

GCGGCAGCAGCGGCGGCAGCGACAAGAAGTACAGC

ATCGGCCTGGCCATCGGCACCAACTCTGTGGGCTG

GGCCGTGATCACCGACGAGTACAAGGTGCCCAGCA

AGAAATTCAAGGTGCTGGGCAACACCGACCGGCAC

AGCATCAAGAAGAACCTGATCGGAGCCCTGCTGTT

CGACAGCGGCGAAACAGCCGAGGCCACCCGGCTGA

AGAGAACCGCCAGAAGAAGATACACCAGACGGAAG

AACCGGATCTGCTATCTGCAAGAGATCTTCAGCAA

CGAGATGGCCAAGGTGGACGACAGCTTCTTCCACA

566

-continued

GACTGGAAGAGTCCTTCCTGGTGGAAGAGGATAAG

AAGCACGAGCGGCACCCCATCTTCGGCAACATCGT

GGACGAGGTGGCCTACCACGAGAAGTACCCCACCA

TCTACCACCTGAGAAAGAAACTGGTGGACAGCACC

GACAAGGCCGACCTGCGGCTGATCTATCTGGCCCT

GGCCCACATGATCAAGTTCCGGGGCCACTTCCTGA

TCGAGGGCGACCTGAACCCCGACAACAGCGACGTG

GACAAGCTGTTCATCCAGCTGGTGCAGACCTACAA

CCAGCTGTTCGAGGAAAACCCCATCAACGCCAGCG

GCGTGGACGCCAAGGCCATCCTGTCTGCCAGACTG

AGCAAGAGCAGACGGCTGGAAAATCTGATCGCCCA

GCTGCCCGGCGAGAAGAAGAATGGCCTGTTCGGAA

ACCTGATTGCCCTGAGCCTGGGCCTGACCCCCAAC

TTCAAGAGCAACTTCGACCTGGCCGAGGATGCCAA

ACTGCAGCTGAGCAAGGACACCTACGACGACGACC

TGGACAACCTGCTGGCCCAGATCGGCGACCAGTAC

GCCGACCTGTTTCTGGCCGCGAAGAACCTGTCCGA

CGCCATCCTGCTGAGCGACATCCTGAGAGTGAACA

CCGAGATCACCAAGGCCCCCCTGAGCGCCTCTATG

ATCAAGAGATACGACGAGCACCACCAGGACCTGAC

CCTGCTGAAAGCTCTCGTGCGGCAGCAGCTGCCTG

AGAAGTACAAAGAGATTTTCTTCGACCAGAGCAAG

AACGGCTACGCCGGCTACATTGACGGCGGAGCCAG

CCAGGAAGAGTTCTACAAGTTCATCAAGCCCATCC

TGGAAAAGATGGACGGCACCGAGGAACTGCTCGTG

AAGCTGAACAGAGAGGACCTGCTGCGGAAGCAGCG

GACCTTCGACAACGGCAGCATCCCCCACCAGATCC

ACCTGGGAGAGCTGCACGCCATTCTGCGGCGGCAG

GAAGATTTTTACCCATTCCTGAAGGACAACCGGGA

AAAGATCGAGAAGATCCTGACCTTCCGCATCCCCT

ACTACGTGGGCCCTCTGGCCAGGGGAAACAGCAGA

TTCGCCTGGATGACCAGAAAGAGCGAGGAAACCAT

CACCCCCTGGAACTTCGAGGAAGTGGTGGACAAGG

GCGCTTCCGCCCAGAGCTTCATCGAGCGGATGACC

AACTTCGATAAGAACCTGCCCAACGAGAAGGTGCT

GCCCAAGCACAGCCTGCTGTACGAGTACTTCACCG

TGTATAACGAGCTGACCAAAGTGAAATACGTGACC

GAGGGAATGAGAAAGCCCGCCTTCCTGAGCGGCGA

GCAGAAAAAGGCCATCGTGGACCTGCTGTTCAAGA

CCAACCGGAAAGTGACCGTGAAGCAGCTGAAAGAG

567

-continued

```
GACTACTTCAAGAAAATCGAGTGCTTCGACTCCGT

GGAAATCTCCGGCGTGGAAGATCGGTTCAACGCCT

CCCTGGGCACATACCACGATCTGCTGAAAATTATC

AAGGACAAGGACTTCCTGGACAATGAGGAAAACGA

GGACATTCTGGAAGATATCGTGCTGACCCTGACAC

TGTTTGAGGACAGAGAGATGATCGAGGAACGGCTG

AAAACCTATGCCCACCTGTTCGACGACAAAGTGAT

GAAGCAGCTGAAGCGGCGGAGATACACCGGCTGGG

GCAGGCTGAGCCGGAAGCTGATCAACGGCATCCGG

GACAAGCAGTCCGGCAAGACAATCCTGGATTTCCT

GAAGTCCGACGGCTTCGCCAACAGAAACTTCATGC

AGCTGATCCACGACGACAGCCTGACCTTTAAAGAG

GACATCCAGAAAGCCCAGGTGTCCGGCCAGGGCGA

TAGCCTGCACGAGCACATTGCCAATCTGGCCGGCA

GCCCCGCCATTAAGAAGGGCATCCTGCAGACAGTG

AAGGTGGTGGACGAGCTCGTGAAAGTGATGGGCCG

GCACAAGCCCGAGAACATCGTGATCGAAATGGCCA

GAGAGAACCAGACCACCCAGAAGGGACAGAAGAAC

AGCCGCGAGAGAATGAAGCGGATCGAAGAGGGCAT

CAAAGAGCTGGGCAGCCAGATCCTGAAAGAACACC

CCGTGGAAAACACCCAGCTGCAGAACGAGAAGCTG

TACCTGTACTACCTGCAGAATGGGCGGGATATGTA

CGTGGACCAGGAACTGGACATCAACCGGCTGTCCG

ACTACGATGTGGACCATATCGTGCCTCAGAGCTTT

CTGAAGGACGACTCCATCGACAACAAGGTGCTGAC

CAGAAGCGACAAGAACCGGGGCAAGAGCGACAACG

TGCCCTCCGAAGAGGTCGTGAAGAAGATGAAGAAC

TACTGGCGGCAGCTGCTGAACGCCAAGCTGATTAC

CCAGAGAAAGTTCGACAATCTGACCAAGGCCGAGA

GAGGCGGCCTGAGCGAACTGGATAAGGCCGGCTTC

ATCAAGAGACAGCTGGTGGAAACCCGGCAGATCAC

AAAGCACGTGGCACAGATCCTGGACTCCCGGATGA

ACACTAAGTACGACGAGAATGACAAGCTGATCCGG

GAAGTGAAAGTGATCACCCTGAAGTCCAAGCTGGT

GTCCGATTTCCGGAAGGATTTCCAGTTTTACAAAG

TGCGCGAGATCAACAACTACCACCACGCCCACGAC

GCCTACCTGAACGCCGTCGTGGGAACCGCCCTGAT

CAAAAAGTACCCTAAGCTGGAAAGCGAGTTCGTGT

ACGGCGACTACAAGGTGTACGACGTGCGGAAGATG

ATCGCCAAGAGCGAGCAGGAAATCGGCAAGGCTAC

CGCCAAGTACTTCTTCTACAGCAACATCATGAACT
```

568

-continued

```
TTTTCAAGACCGAGATTACCCTGGCCAACGGCGAG

ATCCGGAAGCGGCCTCTGATCGAGACAAACGGCGA

AACCGGGGAGATCGTGTGGGATAAGGGCCGGGATT

TTGCCACCGTGCGGAAAGTGCTGAGCATGCCCCAA

GTGAATATCGTGAAAAAGACCGAGGTGCAGACAGG

CGGCTTCAGCAAAGAGTCTATCCTGCCCAAGAGGA

ACAGCGATAAGCTGATCGCCAGAAAGAAGGACTGG

GACCCTAAGAAGTACGGCGGCTTCGACAGCCCCAC

CGTGGCCTATTCTGTGCTGGTGGTGGCCAAAGTGG

AAAAGGGCAAGTCCAAGAAACTGAAGAGTGTGAAA

GAGCTGCTGGGGATCACCATCATGGAAAGAAGCAG

CTTCGAGAAGAATCCCATCGACTTTCTGGAAGCCA

AGGGCTACAAAGAAGTGAAAAAGGACCTGATCATC

AAGCTGCCTAAGTACTCCCTGTTCGAGCTGGAAAA

CGGCCGGAAGAGAATGCTGGCCTCTGCCGGCGAAC

TGCAGAAGGGAAACGAACTGGCCCTGCCCTCCAAA

TATGTGAACTTCCTGTACCTGGCCAGCCACTATGA

GAAGCTGAAGGGCTCCCCCGAGGATAATGAGCAGA

AACAGCTGTTTGTGGAACAGCACAAGCACTACCTG

GACGAGATCATCGAGCAGATCAGCGAGTTCTCCAA

GAGAGTGATCCTGGCCGACGCTAATCTGGACAAAG

TGCTGTCCGCCTACAACAAGCACCGGGATAAGCCC

ATCAGAGAGCAGGCCGAGAATATCATCCACCTGTT

TACCCTGACCAATCTGGGAGCCCCTGCCGCCTTCA

AGTACTTTGACACCACCATCGACCGGAAGAGGTAC

ACCAGCACCAAAGAGGTGCTGGACGCCACCCTGAT

CCACCAGAGCATCACCGGCCTGTACGAGACACGGA

TCGACCTGTCTCAGCTGGGAGGTGACAGCGGCGGG

AGCGGCGGGAGCGGGGGGAGCACTAATCTGAGCGA

CATCATTGAGAAGGAGACTGGGAAACAGCTGGTCA

TTCAGGAGTCCATCCTGATGCTGCCTGAGGAGGTG

GAGGAAGTGATCGGCAACAAGCCAGAGTCTGACAT

CCTGGTGCACACCGCCTACGACGAGTCCACAGATG

AGAATGTGATGCTGCTGACCTCTGACGCCCCCGAG

TATAAGCCTTGGGCCCTGGTCATCCAGGATTCTAA

CGGCGAGAATAAGATCAAGATGCTGAGCGGAGGAT

CCGGAGGATCTGGAGGCAGCACCAACCTGTCTGAC

ATCATCGAGAAGGAGACAGGCAAGCAGCTGGTCAT

CCAGGAGAGCATCCTGATGCTGCCCGAAGAAGTCG

AAGAAGTGATCGGAAACAAGCCTGAGAGCGATATC
```

-continued

CTGGTCCATACCGCCTACGACGAGAGTACCGACGA

AAATGTGATGCTGCTGACATCCGACGCCCCAGAGT

ATAAGCCCTGGGCTCTGGTCATCCAGGATTCCAAC

GGAGAGAACAAAATCAAAATGCTGTCTGGCGGCTC

AAAAAGAACCGCCGACGGCAGCGAATTCGAGCCCA

AGAAGAAGAGGAAAGTCTAACCGGTCATCATCACC

ATCACCATTGAGTTTAAACCCGCTGATCAGCCTCG

ACTGTGCCTTCTAGTTGCCAGCCATCTGTTGTTTG

CCCCTCCCCCGTGCCTTCCTTGACCCTGGAAGGTG

CCACTCCCACTGTCCTTTCCTAATAAAATGAGGAA

ATTGCATCGCATTGTCTGAGTAGGTGTCATTCTAT

TCTGGGGGGTGGGGTGGGGCAGGACAGCAAGGGGG

AGGATTGGGAAGACAATAGCAGGCATGCTGGGGAT

GCGGTGGGCTCTATGGCTTCTGAGGCGGAAAGAAC

CAGCTGGGGCTCGATACCGTCGACCTCTAGCTAGA

GCTTGGCGTAATCATGGTCATAGCTGTTTCCTGTG

TGAAATTGTTATCCGCTCACAATTCCACACAACAT

ACGAGCCGGAAGCATAAAGTGTAAAGCCTAGGGTG

CCTAATGAGTGAGCTAACTCACATTAATTGCGTTG

CGCTCACTGCCCGCTTTCCAGTCGGGAAACCTGTC

GTGCCAGCTGCATTAATGAATCGGCCAACGCGCGG

GGAGAGGCGGTTTGCGTATTGGGCGCTCTTCCGCT

TCCTCGCTCACTGACTCGCTGCGCTCGGTCGTTCG

GCTGCGGCGAGCGGTATCAGCTCACTCAAAGGCGG

TAATACGGTTATCCACAGAATCAGGGGATAACGCA

GGAAAGAACATGTGAGCAAAAGGCCAGCAAAAGGC

CAGGAACCGTAAAAAGGCCGCGTTGCTGGCGTTTT

TCCATAGGCTCCGCCCCCCTGACGAGCATCACAAA

AATCGACGCTCAAGTCAGAGGTGGCGAAACCCGAC

AGGACTATAAAGATACCAGGCGTTTCCCCCTGGAA

GCTCCCTCGTGCGCTCTCCTGTTCCGACCCTGCCG

CTTACCGGATACCTGTCCGCCTTTCTCCCTTCGGG

AAGCGTGGCGCTTTCTCATAGCTCACGCTGTAGGT

A7CTCAGTTCGGTGTAGGTCGTTCGCTCCAAGCTG

GGCTGTGTGCACGAACCCCCCGTTCAGCCCGACCG

CTGCGCCTTATCCGGTAACTATCGTCTTGAGTCCA

ACCCGGTAAGACACGACTTATCGCCACTGGCAGCA

GCCACTGGTAACAGGATTAGCAGAGCGAGGTATGT

AGGCGGTGCTACAGAGTTCTTGAAGTGGTGGCCTA

ACTACGGCTACACTAGAAGAACAGTATTTGGTATC

TGCGCTCTGCTGAAGCCAGTTACCTTCGGAAAAAG

-continued

AGTTGGTAGCTCTTGATCCGGCAAACAAACCACCG

CTGGTAGCGGTGGTTTTTTTGTTTGCAAGCAGCAG

ATTACGCGCAGAAAAAAAGGATCTCAAGAAGATCC

TTTGATCTTTTCTACGGGGTCTGACACTCAGTGGA

ACGAAAACTCACGTTAAGGGATTTTGGTCATGAGA

TTATCAAAAAGGATCTTCACCTAGATCCTTTTAAA

TTAAAAATGAAGTTTTAAATCAATCTAAAGTATAT

ATGAGTAAACTTGGTCTGACAGTTACCAATGCTTA

ATCAGTGAGGCACCTATCTCAGCGATCTGTCTATT

TCGTTCATCCATAGTTGCCTGACTCCCCGTCGTGT

AGATAACTACGATACGGGAGGGCTTACCATCTGGC

CCCAGTGCTGCAATGATACCGCGAGACCCACGCTC

ACCGGCTCCAGATTTATCAGCAATAAACCAGCCAG

CCGGAAGGGCCGAGCGCAGAAGTGGTCCTGCAACT

TTATCCGCCTCCATCCAGTCTATTAATTGTTGCCG

GGAAGCTAGAGTAAGTAGTTCGCCAGTTAATAGTT

TGCGCAACGTTGTTGCCATTGCTACAGGCATCGTG

GTGTCACGCTCGTCGTTTGGTATGGCTTCATTCAG

CTCCGGTTCCCAACGATCAAGGCGAGTTACATGAT

CCCCCATGTTGTGCAAAAAAGCGGTTAGCTCCTTC

GGTCCTCCGATCGTTGTCAGAAGTAAGTTGGCCGC

AGTGTTATCACTCATGGTTATGGCAGCACTGCATA

ATTCTCTTACTGTCATGCCATCCGTAAGATGCTTT

TCTGTGACTGGTGAGTACTCAACCAAGTCATTCTG

AGAATAGTGTATGCGGCGACCGAGTTGCTCTTGCC

CGGCGTCAATACGGGATAATACCGCGCCACATAGC

AGAACTTTAAAAGTGCTCATCATTGGAAAACGTTC

TTCGGGGCGAAAACTCTCAAGGATCTTACCGCTGT

TGAGATCCAGTTCGATGTAACCCACTCGTGCACCC

AACTGATCTTCAGCATCTTTTACTTTCACCAGCGT

TTCTGGGTGAGCAAAAACAGGAAGGCAAAATGCCG

CAAAAAAGGGAATAAGGGCGACACGGAAATGTTGA

ATACTCATACTCTTCCTTTTTCAATATTATTGAAG

CATTTATCAGGGTTATTGTCTCATGAGCGGATACA

TATTTGAATGTATTTA.GAAAAATAAACAAATAGG

GGTTCCGCGCACATTTCCCCGAAAAGTGCCACCTG

ACGTCGACGGATCGGGAGATCGATCTCCCGATCCC

CTAGGGTCGACTCTCAGTACAATCTGCTCTGATGC

CGCATAGTTAAGCCAGTATCTGCTCCCTGCTTGTG

TGTTGGAGGTCGCTGAGTAGTGCGCGAGCAAAATT

```
-continued
TAAGCTACAACAAGGCAAGGCTTGACCGACAATTG

CATGAAGAATCTGCTTAGGGTTAGGCGTTTTGCGC

TGCTTCGCGATGTACGGGCCAGATATACGCGTTGA

CATTGATTATTGACTAGTTATTAATAGTAATCAAT

TACGGGGTCATTAGTTCATAGCCCATATATGGAGT

TCCGCGTTACATAACTTACGGTAAATGGCCCGCCT

GGCTGACCGCCCAACGACCCCCGCCCATTGACGTC

AATAATGACGTATGTTCCCATAGTAACGCCAATAG

GGACTTTCCATTGACGTCAATGGGTGGAGTATTTA

CGGTAAACTGCCCACTTGGCAGTACATCAAGTGTA

TC
```

Figure 2:
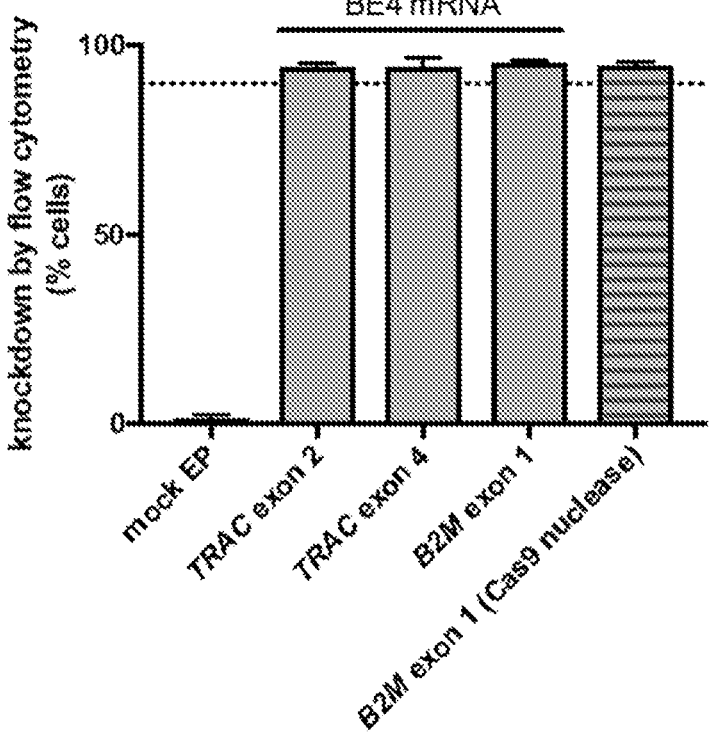
FIG. 2 is a graph of the percentage of cells with knocked down expression of target genes after base editing. "EP" denotes electroporation.

To ascertain the effectiveness of BE4 in knocking down or out protein expression in immune cells, a first population of immune cells was co-transfected with mRNA encoding BE4 and an sgRNA that targeted the C base complementary to the G base of the donor or acceptor splice site of TRAC exon 2, TRAC exon 4, or B2M exon 1, depending on the specific target site. mRNA was produced by in vitro transcription, (TriLin Biotechnologies). Briefly, 4 g of BE4 mRNA and 2 μg of synthetic gRNA were electroporated into 1M CD3+ T cells (Nucleofector™ Platform, Lonza Bioscience). The cells were then cultured for 3 days to allow sufficient time for base-editing. For comparison, a second population of immune cells was co-transfected with mRNA encoding a Cas9 nuclease and sgRNA that target the G base of the donor splice site of B2M exon 1. No discernible difference between BE4 editing and the Cas9 editing was observed, and the knockdown for each edited gene was greater than 90%, whereas unelectroporated control cells had no significant knockdown (FIG. 2).

Figure 3:
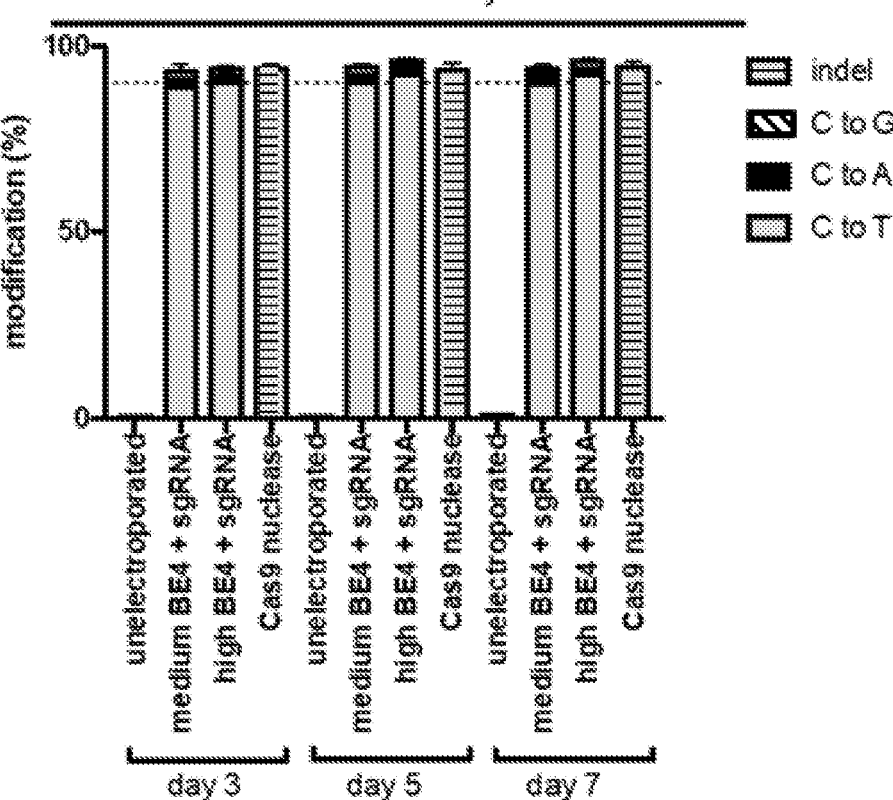
FIG. 3 is a graph of the percentages of the observed types of genetic modification in untransduced cells or in cells transduced with a BE4 base editing system or a Cas9 nuclease.

It was hypothesized that the genetic modifications responsible for the observed knockdown of the targeted genes would differ if the cells were transfected with mRNA encoding BE4, which catalyzes single strand nicks, or with the Cas9 nuclease that catalyzes double-strand breaks. To test this hypothesis, immune cells were co-transfected with either 2 g BE4/1 μg sgRNA (medium) or 4 μg BE4/2 μg sgRNA (high) RNA encoding the BE4 base editor and sgRNA that target the G base of the donor splice site of the B2M exon 1. After incubation for 3, 5, and 7 days, DNA was collected and sequenced. Referring to FIG. 3, the majority of base edits revealed disruption of only the splice site and in the manner expected (i.e., C to T transition in the antisense strand was incorporated, resulting in a G to A transition in the sense strand). These results contrasted with those obtained from cells transfected with a Cas9 nuclease, which show that most edits in the Cas9 transfected cells were indels (FIG. 3).

Figure 4:
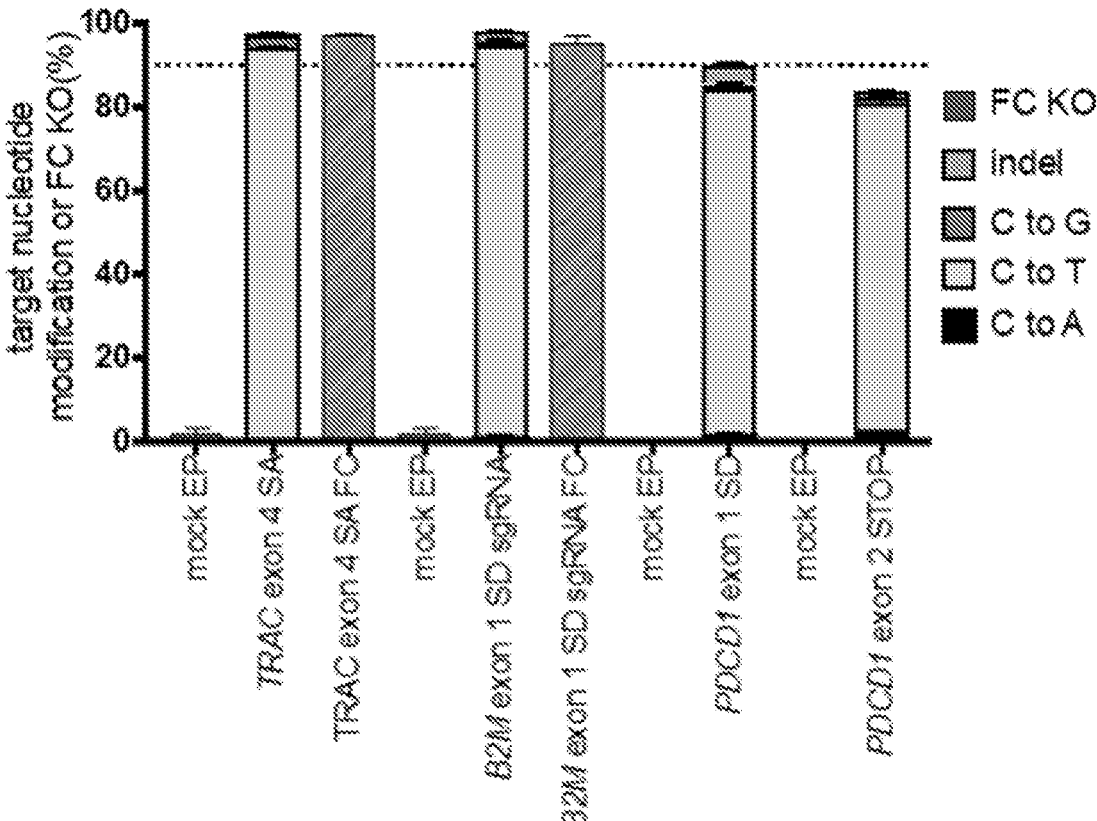
FIG. 4 is a graph depicting target nucleotide modification percentage as measured by percentage of cells that are negative for target protein expression as determined by flow cytometry (FC) in cells transduced with BE4 and sgRNAs directing BE4 to splice site acceptors (SA) or donors (SD) or that generate a STOP codon. Control cells were mock electroporated (EP).
Figure 5:
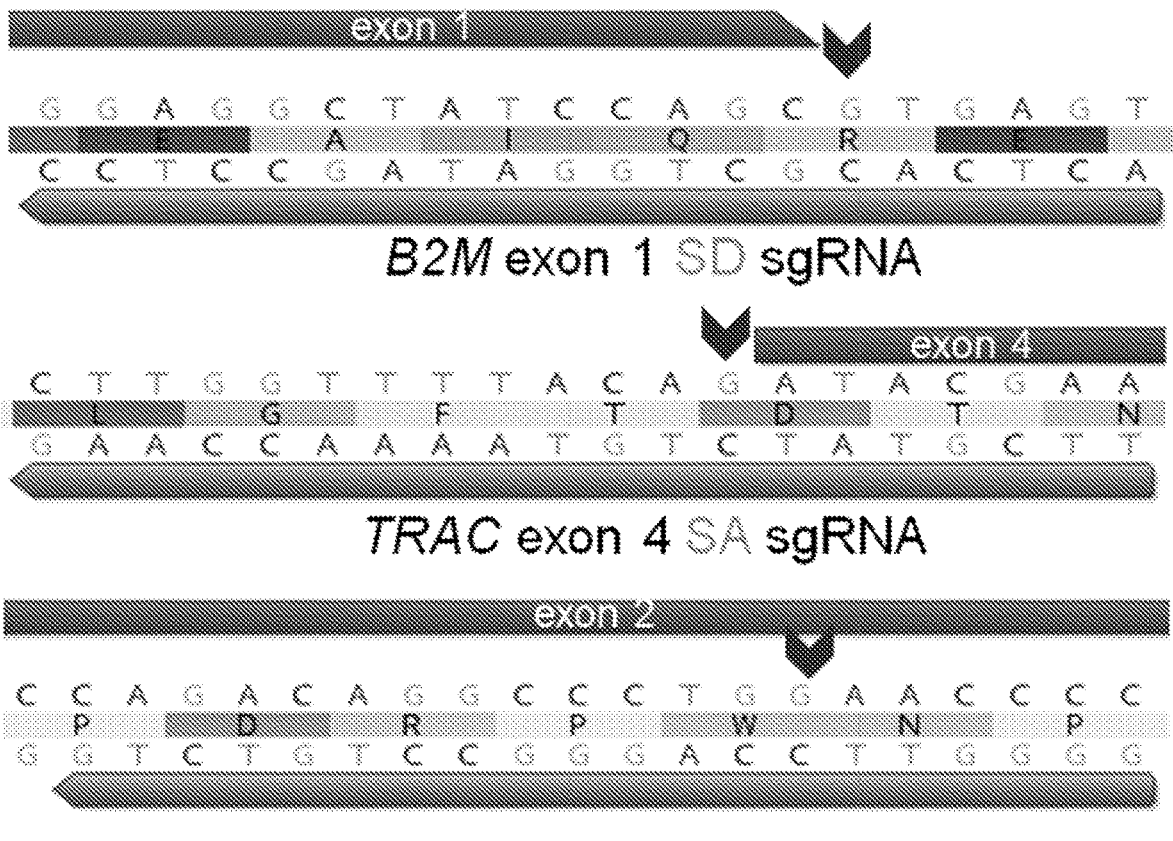
FIG. 5 is a diagram of the BE4 system disrupting splice site acceptors (SA), splice donors (SD), or generate STOP codons. Figure discloses SEQ ID NOS 1497-1499 and 1501-1503, respectively, in order of appearance.

Disruption of splice site and the introduction of stop codons can be effective in knocking down expression of a target gene. BE4-mediated editing of the splice acceptor in TRAC exon 4 and the splice donor in B2M exon 1 and PDCD1 exon 1 resulted in reduced expression of the full-length proteins (FIGS. 4 and 5). The BE4-mediated changes observed in the splice site were C to T transitions, although indels and C to G transversions were also observed. Insertion of an ochre stop codon into exon 2 of the PDCD1 gene, in which consecutive cytidine residues in the exon were targeted and edited to thymidine residues, also resulted in significant knock down of gene expression, albeit a lesser reduction than that seen for the TRAC and B2M genes (FIG. 4). These results further suggest that BE4-mediated single or consecutive cytidine base editing of genes expressed in immune cells results in efficient reduction of gene expression.

Example 2: In Silico Analysis of Spice Site Disruption and Stop Codon Insertion To determine if designed gRNA would bind to off-site targets, the nucleic acid sequences of the gRNAs were analyzed using CAS-OFFinder. Referring to FIG. 6, an "X" bulge type indicates that the gRNA aligns with the genomic DNA and any discrepancy is a mismatch. As the number of mismatches increases from one to four, the potential off-site binding increases. For example, results for the TRAC exon 4 splice acceptor show that when there are three mismatches, there are 26 offsite binding possibilities, while there are 164 with four mismatches.

If the gRNA has a bulge, wherein the gRNA has twenty base pairs, but aligns with nineteen base pairs of genomic DNA, a bulge results. Again, referring to FIG. 6, when the TRAC exon 4 splice acceptor gRNA has a bulge of one base pair, the number of offsite binding possibilities increases with increasing mismatches; however, the number of possibilities is significantly lower than when there is no bulge (i.e., when the bulge size is zero).

Example 3: Multiplex Base Editing in Immune Cells

To determine if BE4 could mediate base editing of multiple genes to generate a multi-knockdown cell, immune cells were co-transfected with mRNA encoding a BE4 base editor along with sgRNA that target specific sites in B2M, TRAC, PD1, or in combinations thereof. Referring to FIG. 7, the BE4 system elicited effective knockdown, as measured by flow cytometry, to identify the percentage of cells with decreased protein production in single, double, and triple gene edits. The cells were gated on B2M and CD3 expression, with CD3 expression serving as a proxy for TRAC expression. Because PD1 staining is inefficient, direct measurement of cells expressing this protein was not performed. No differences were observed between cell populations with single, double, and triple gene edits, and immune cells modified to knock-down expression of B2M, TRAC, and PD1 (a triple gene edit) are detectably distinct from non-modified control immune cell (FIG. 8).

Figure 9:
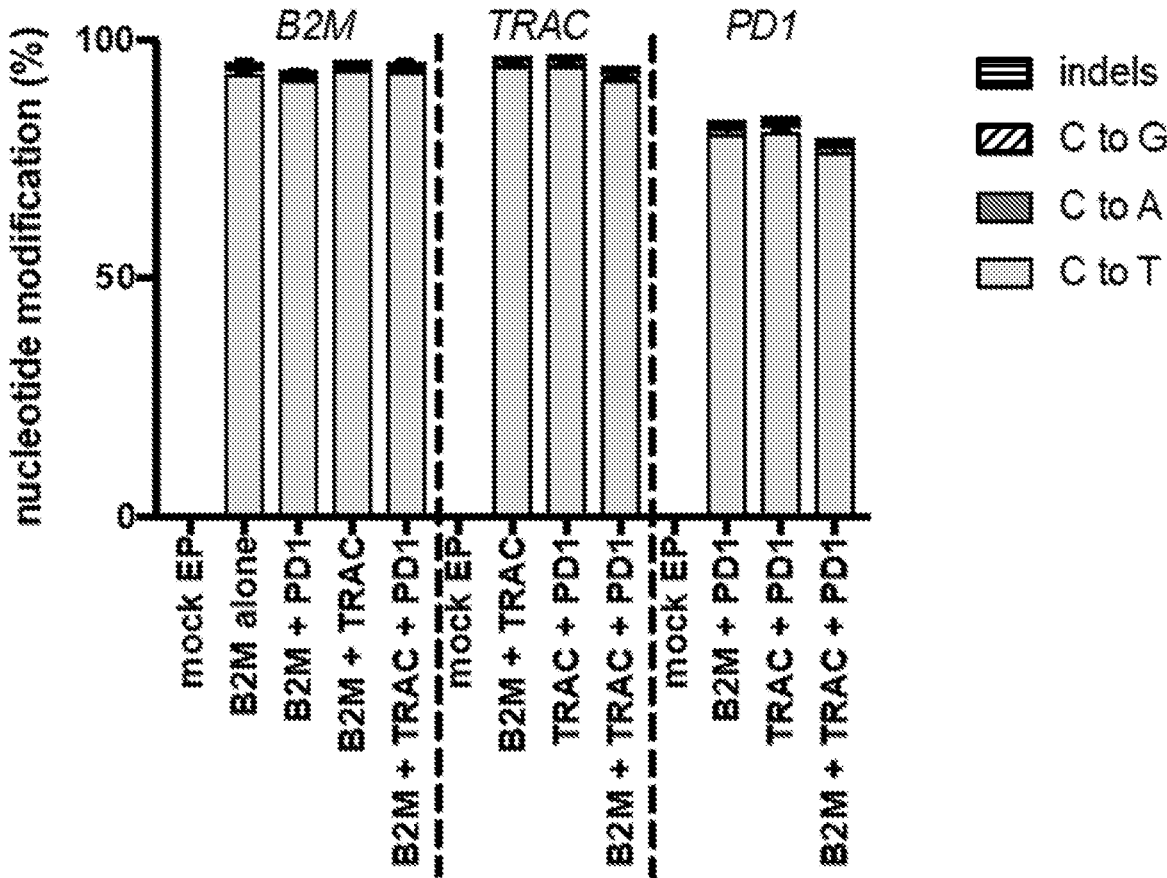
FIG. 9 is a graph illustration the effectiveness of the base editing techniques described herein to modify specific genes that can negatively impact CAR-T immunotherapy.

The modifications to the genes responsible for the decreased protein expression are summarized in FIG. 9. Specifically, and similarly to the mechanism resulting in decreased expression in single gene modification described in Example 1, C to T transitions constitute the vast number of edits observed in the modified B2M single modified gene cell population and in the B2M+PD1, B2M+TRAC, and B2M+TRAC+PD1 multiple modified genes cell populations. Indels and transversions constitute an insignificant minority of observed genetic changes in the edited genes.

Figure 10:
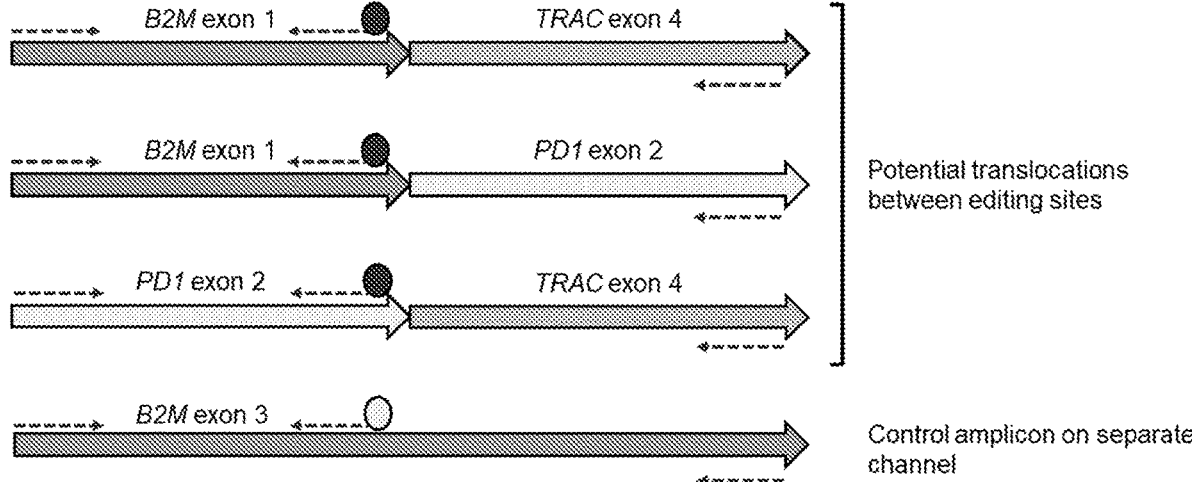
FIG. 10 is a diagram depicting a droplet digital PCR (ddPCR) protocol to detect and quantify gene modifications and translocations.
Figure 11:
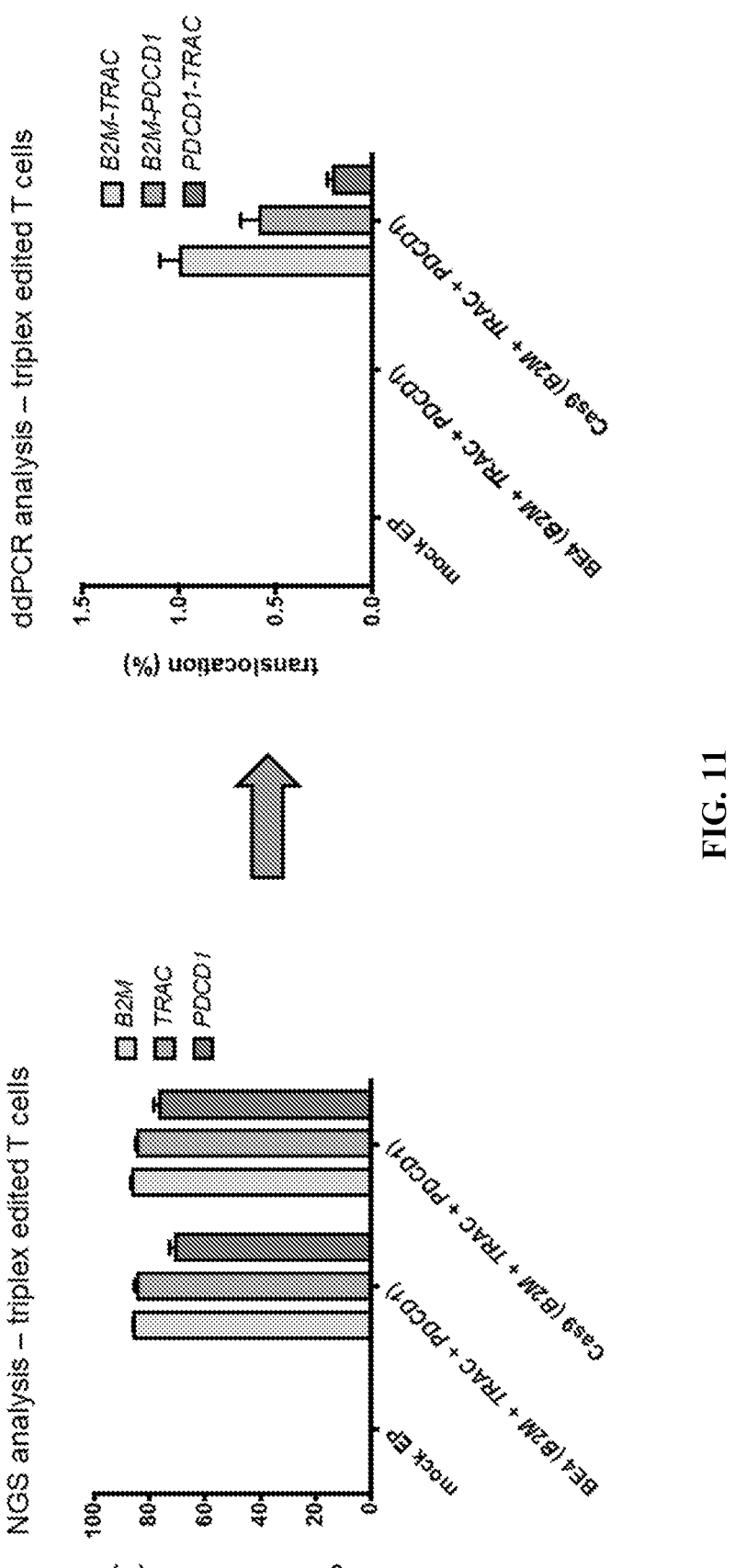
FIG. 11 presents two graphs showing the data generated from next generation sequencing (NGS) analysis or ddPCR of cells edited using either the BE4 system or the Cas9 system.

Thus, concurrent modification of three genetic loci by base editing produced highly efficient gene knockouts with no detectable translocation events as assessed by Uni-Directional Targeted Sequencing (UDiTaS; Giannoukos et al., BMC Genomics. 2018 Mar. 21; 19(1):212. doi: 10.1186/s12864-018-4561-9). Additionally, translocations were not detected in BE4-edited genes. A droplet digital polymerase chain reaction (ddPCR) strategy (FIG. 10) was employed to detect translocations between the B2M, TRAC, and PD1 BE4-edited genes. DNA extracted from cells modified with BE4 or Cas9 to generate B2M+TRAC+PD1 edits was analyzed with next generation sequencing (NGS) using a QX200 droplet digital instrument (Bio-Rad) to determine the exact sequence of the BE4 and Cas9 edits. As shown on the left panel of FIG. 11, the B2M, TRAC, and PD1 genes were modified in most cells. ddPCR analysis showed that translocations were not present in the BE4-edited cells, but were observed in approximately 1.7% of the Cas9-edited cells (FIG. 11, right panel). Table 21 further illustrates that translocations were not observed in the BE4-edited cells.

TABLE 21

| Base Editor | Translocation | Control amplicon droplets | Experimental amplicon droplets |
|---|---|---|---|
| Cas9 nuclease | B2M-TRAC | 61,206 | 585 |
| | B2M-PDCD1 | 55,970 | 291 |
| | PDCD1-TRAC | 59,600 | 112 |
| BE4 | B2M-TRAC | 90,717 | 0 |
| | B2M-PDCD1 | 89,028 | 0 |
| | PDCD1-TRAC | 83,501 | 0 |

Example 4: BE4-Mediated Editing of Cbl Proto-Oncogene B (CBLB)

Figure 12:
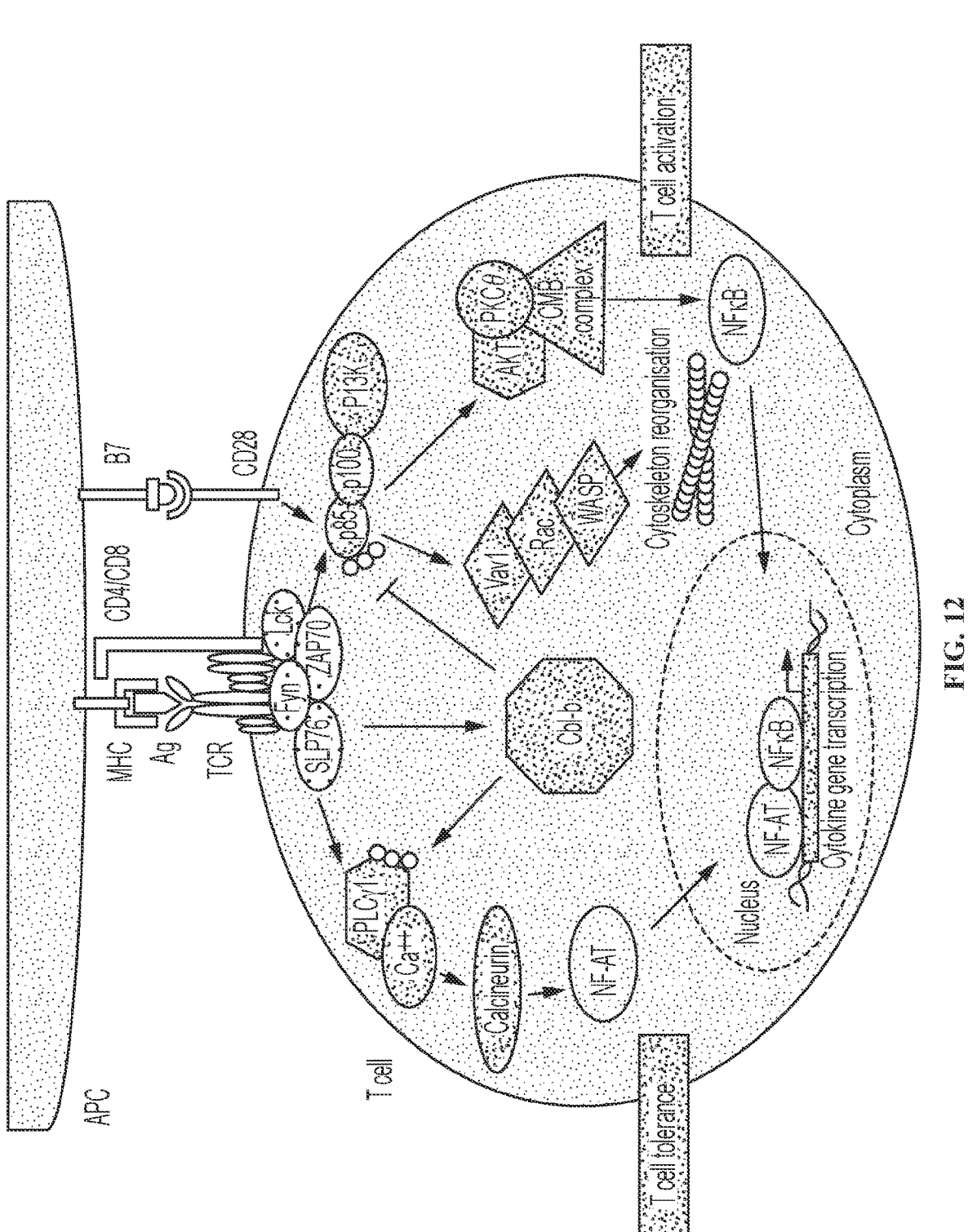
FIG. 12 is a schematic diagram that illustrates the role Cbl-b plays in suppressing T cell activation.

Cbl-b is a T cell receptor (TCR) signaling protein that negatively regulates TCR complex signaling (FIG. 12). Because T cells have a lower activation threshold when Cbl-b signaling is inhibited, knocking out or down this gene could significantly improve the effectiveness of a T cell or a T cell expressing a CAR. To determine if the Cbl-b gene was susceptible cytidine deamination mediated modification, cells were co-transfected with mRNA encoding a BE4 and sgRNA that target the splice site acceptor of exon 8 and 16, the splice site donor of exons 8, 10, 11, and 12, or that would promote the insertion of a STOP codon in exons 1, 4, and 8. Resulting cells were analyzed with flow cytometry.

Figure 13:
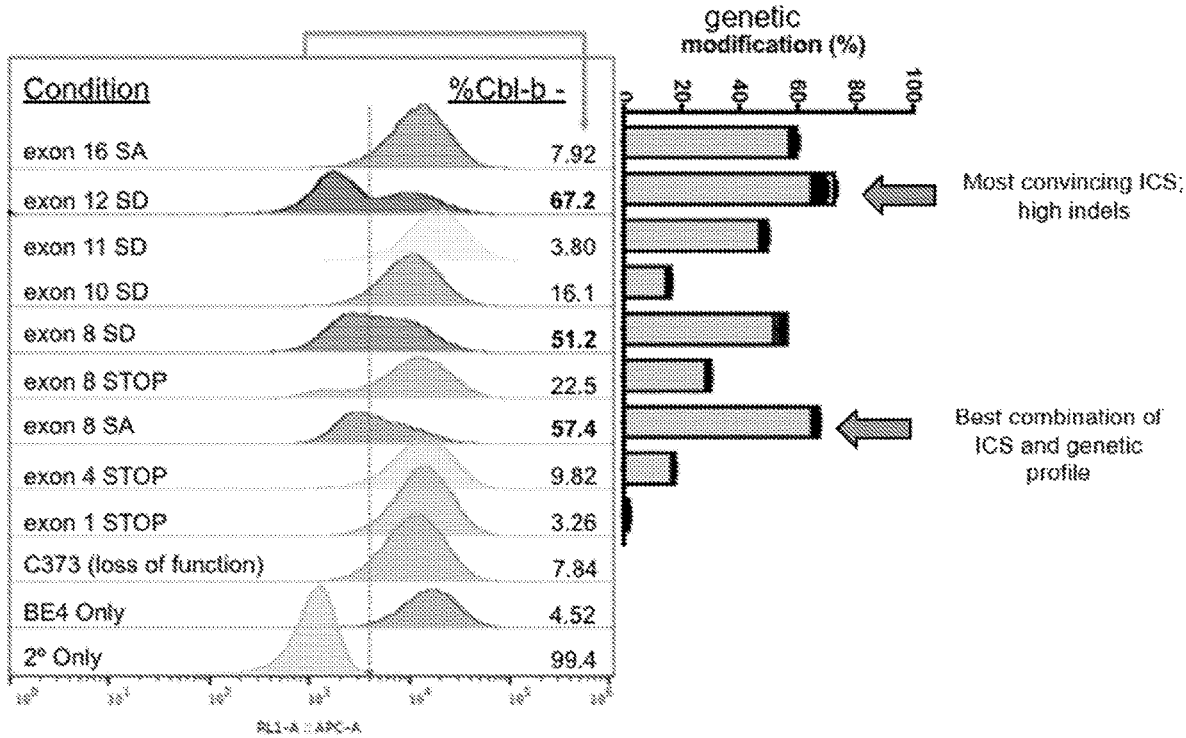
FIG. 13 is a graph depicting the efficiency of Cbl-b knockdown by disruption of splice sites. SA=Splice Acceptor; SD=Splice Donor; STOP—generated STOP codon; 2° Only=secondary antibody only; C373 refers to a loss of function variant (C373R); RL1-A::APC-A=laser; ICS=intracellular staining.

Referring to FIG. 13, disruption of the splice site donor of exon 12 and the splice site acceptor of exon 8 resulted in the greatest reduction of Cbl-b expression (67.2% and 57.4%, respectively). And of the cells transfected with the exon 8 splice site acceptor and the exon 12 splice site donor sgRNAs, slightly more than 60% of the cells were edited successfully (FIG. 13, bar graph).

Example 5: Cas12b Nuclease Characterization in Immune Cells

Figure 14:
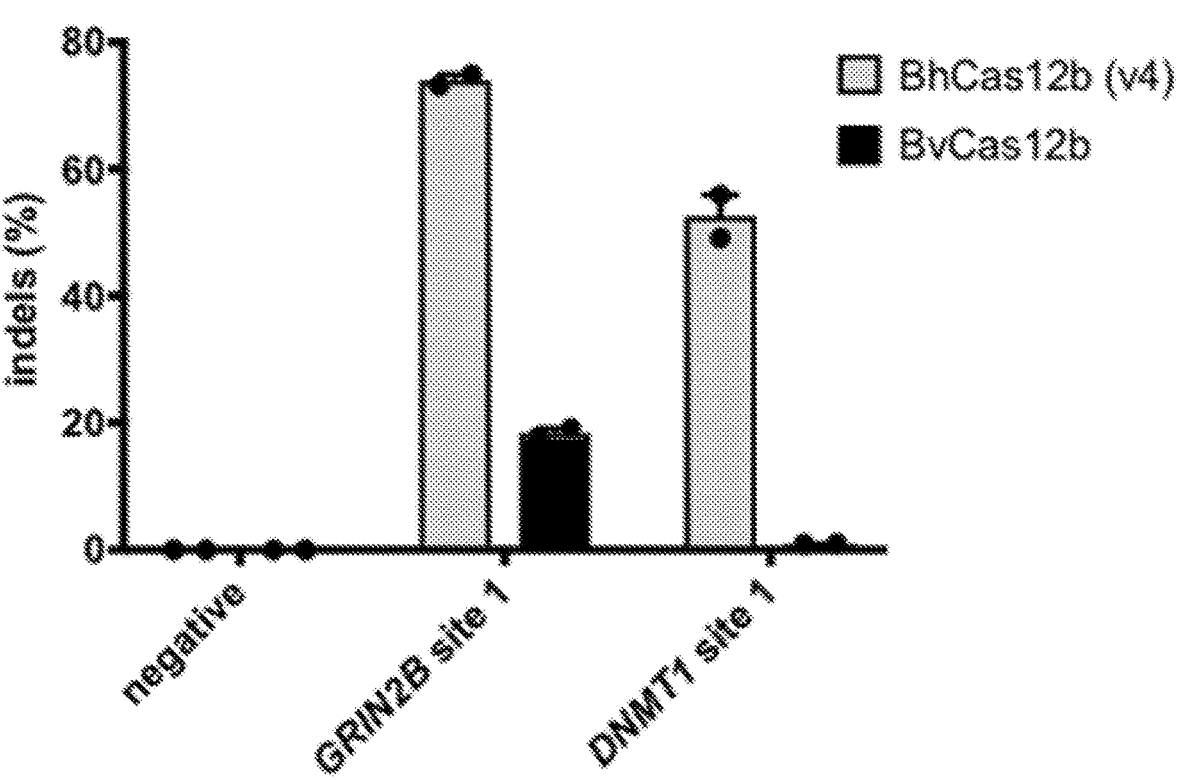
FIG. 14 is a graph illustrating the rate of Cas12b-mediated indels in the GRIN2B and DNMT1 genes in T cells. EP denotes electroporation.

Cas12b/c2c1 site specifically targets and cleaves both strands of a double stranded nucleic acid molecule. Two different Cas12b/c2c1 proteins, BhCas12b and BvCas12b, were characterized by determining the propensity the enzymes for mediating indels in the target nucleic acid molecule. mRNA encoding the Cas12b/c2c1 proteins was electroporated into T cells along with guide RNAs specific for a locus in the GRIN2B gene and for a locus in the DNMT1 gene. The cells were cultured for 3-5 days, followed by isolation of cellular DNA. Indel rates were determined by Next Generation Sequencing. Referring to FIG. 14, DNA isolated from cells treated with the BhCas12b protein had a much higher percentage (approximately 75%) of indels in the GRIN2B gene than did the DNA isolated from cells treated with the BvCas12b protein (approximately 20%). Indels in the DNMT1 gene were also observed at a higher rate in the DNA isolated from cells treated with BhCas12b (approximately 20%) than observed in the DNA isolated from cells treated with BvCas12b (approximately 0%).

Figure 15:
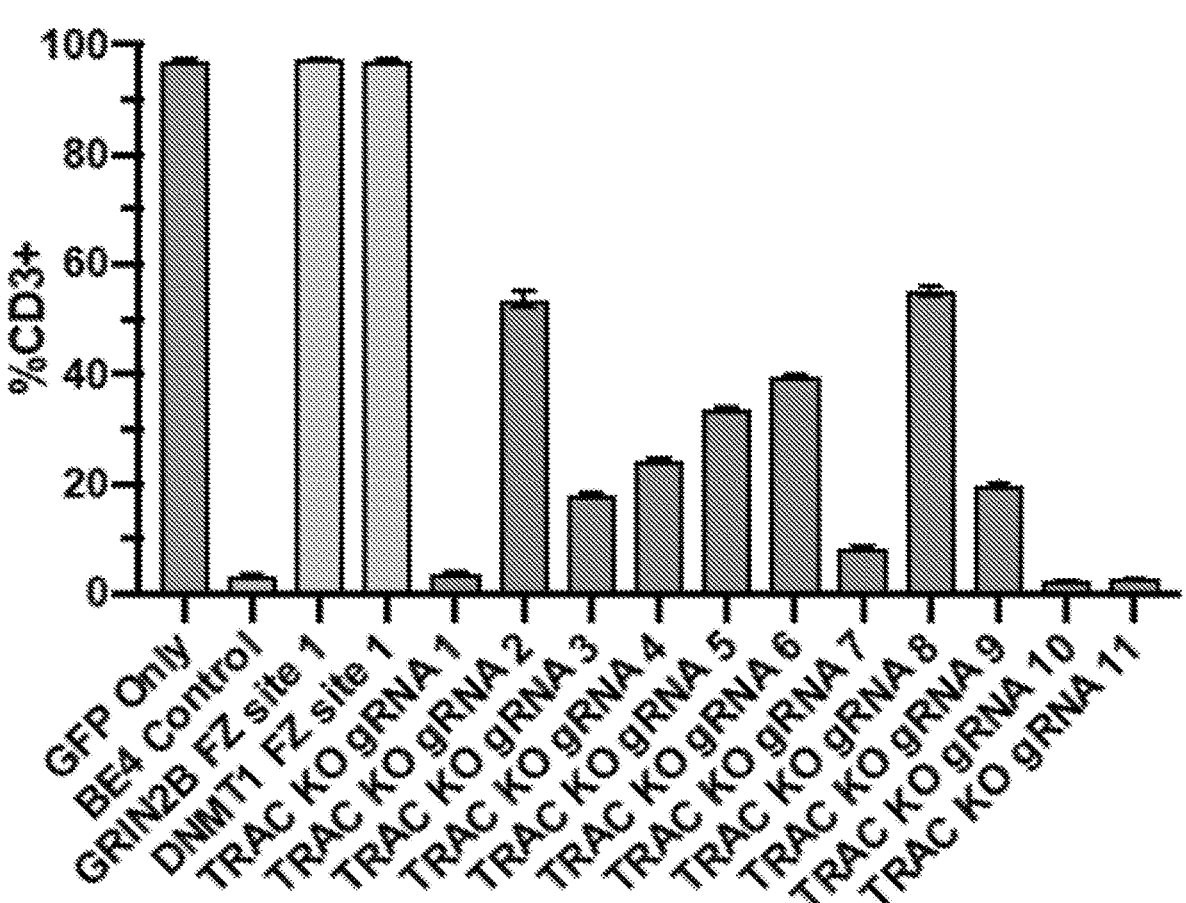
FIG. 15 is a graph summarizing fluorescence assisted cell sorting (FACS) data of cells transduced via electroporation (EP) with by Cas12b and guide RNAs specific for TRAC, GRIN2B, and DNMT1 and gated for CD3.

The BhCas12b (V4) protein was used to disrupt the TRAC gene. T cells were transduced via electroporation with the mRNA encoding the BhCas12b (V4) protein along with guide RNAs specific for loci in the GRIN2B, DNMT1, and TRAC genes. 96 hours post-electroporation, cells were assessed using fluorescence assisted cell sorting (FACS) analysis, with cells being gated for CD3 (a proxy for TRAC). Referring to FIG. 15, approximately 95% of T cells transduced with a plasmid encoding GFP or with BhCas12b (V4) and guide RNAs specific for GRIN2B or DNMT1 were CD3+. Those cells transduced to express BhCas12b (V4) and guide RNAs specific for loci in the TRAC gene were less likely to be CD3+(approximately 2% to approximately 50%, depending on the guide RNA used). Three of the eleven TRAC guide RNAs tested led to approximately 100% BhCas12b (V4)-mediated indels.

Example 6: CAR-P2A-mCherry Lentivirus Expression Characterization

Figure 16:
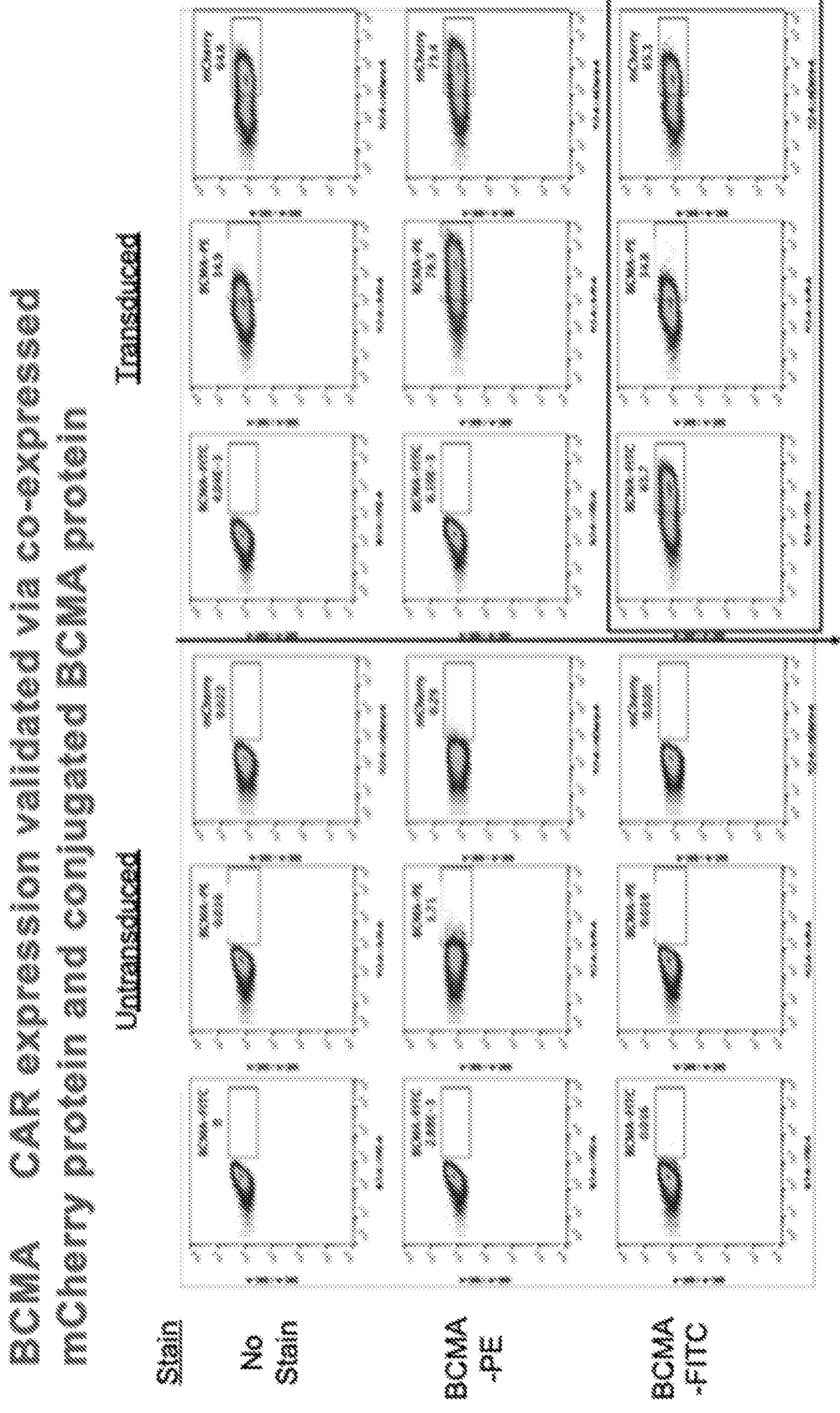
FIG. 16 is a scatter plot of fluorescence assisted cell sorting data of cells transduced CAR-P2A-mCherry lentivirus demonstrating CAR expression.
Figure 17:
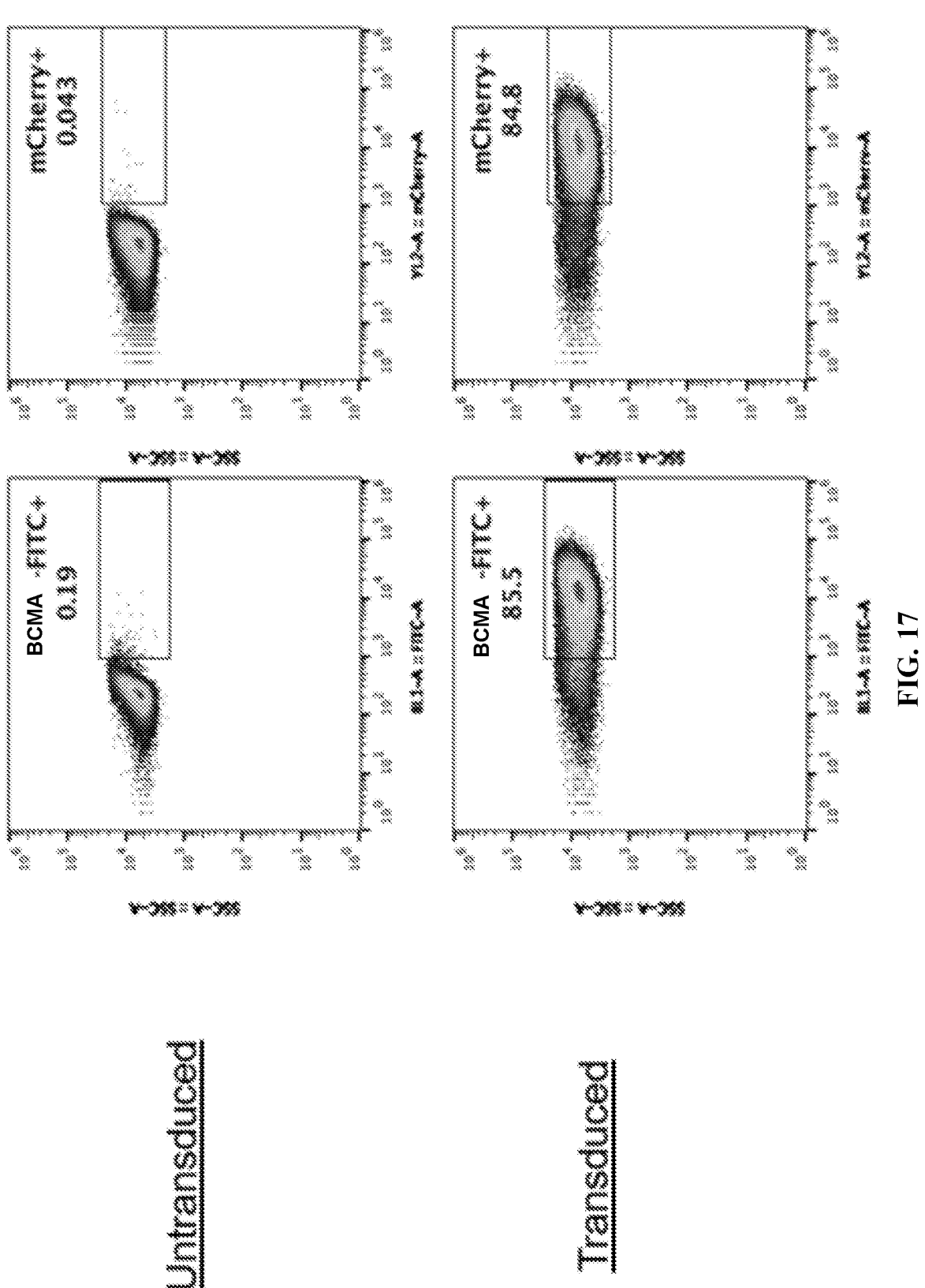
FIG. 17 is a scatter plot of fluorescence assisted cell sorting data demonstrating CAR expression in cells transduced with a poly(1,8-octanediol citrate) (POC) lentiviral vector.

Cells were transduced to express a chimeric antigen receptor (CAR) using the CAR-P2A-mCherry lentivirus and analyzed for CAR expression using fluorescence assisted cell sorting (FACS). Cells were unstained, incubated with a BCMA protein conjugated to R-phycoerythrin (PE) or fluorescein isothiocyanate (FITC). Because BCMA is the CAR's target antigen, cells expressing the CAR will bind dye-labeled BCMA. Referring to FIG. 16, for cells that were not stained, FACS analysis only detected the presence of mCherry in the transduced sample, with some spillover into the PE channel. The BCMA-PE channel shows a highly positive signal beyond what was seen in the spillover, and these results were confirmed in cells incubated with BCMA-FITC. The dye-labeled BCMA protein detection results suggest almost identical expression of the CAR as that seen for mCherry. Referring to FIG. 17, 85% CAR expression was detected via FACS analysis in cells transduced with a poly(1,8-octanediol citrate) (POC) lentiviral vector.

Example 7: BE4 Produces Efficient, Durable Gene Knockout with High Product Purity BE4 mediates base editing of multiple genes to generate a multi-knockdown cell. Immune cells were co-transfected with mRNA encoding a BE4 base editor along with sgRNA that target specific sites in B2M, TRAC, PD1, or in combinations thereof. As shown by sequencing data, base editing was efficient at modifying cells and durable up to at least 7 days (FIG. 18). High product purity was observed, as C to T transitions constituted the vast number of edits observed. Indels and C-to-G and C-to-A transversions constituted an insignificant minority of observed genetic changes in the edited genes. Base editing was also as efficient as spCas9 nuclease at generating desired modifications.

Figures 19A, 19B:
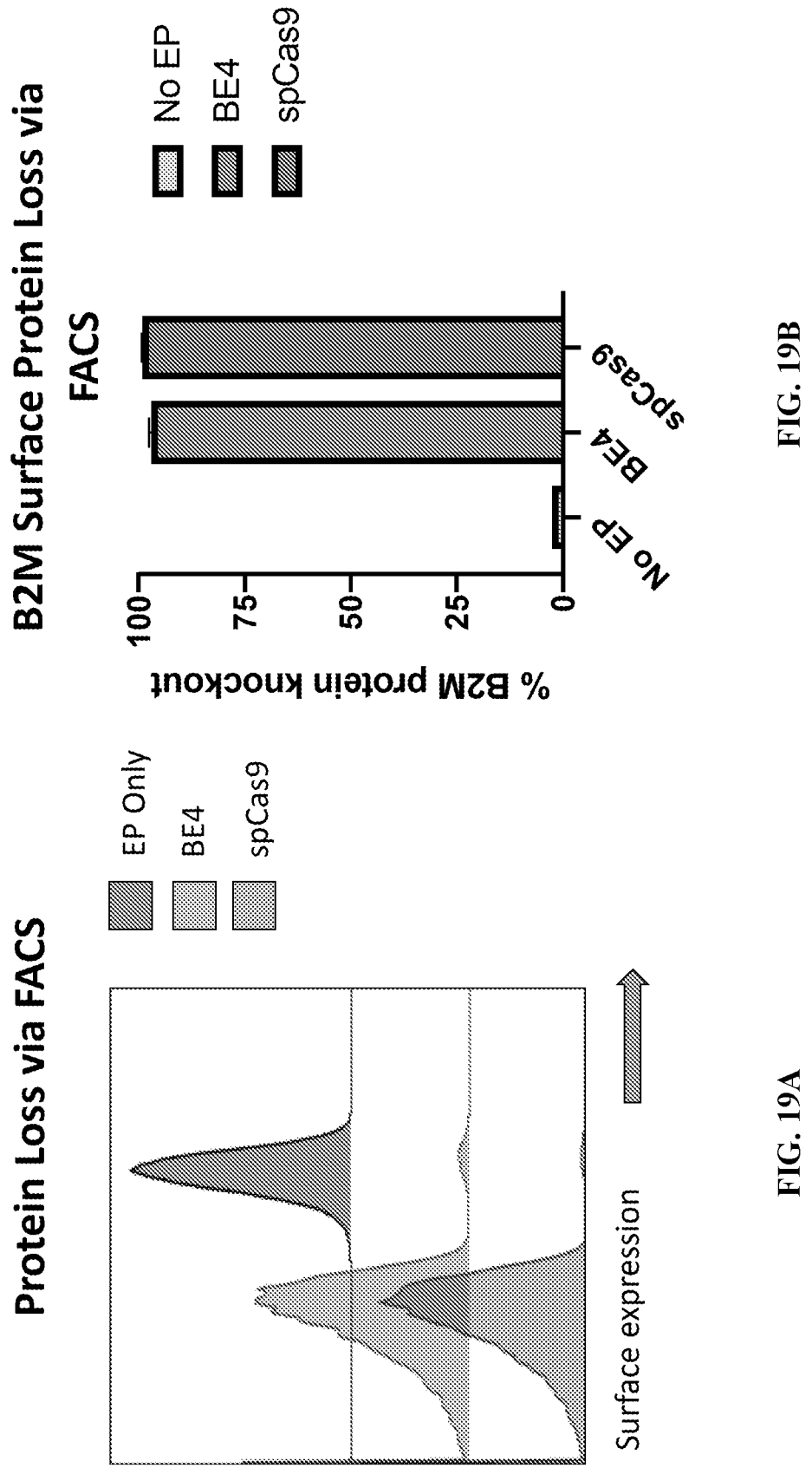
FIG. 19A is a representative FACS analysis showing loss of surface expression of a protein due to gene knockout by BE4 or spCas9.
FIG. 19B is a graph show that gene knockout by BE4 or spCas9 produces loss of B2M surface expression.

The BE4 system elicited effective knockdown as measured by flow cytometry, which identifies the percentage of cells with decreased surface expression (FIG. 19A). Cells gated on B2M expression displayed loss of B2M protein on the cell surface. As measured by flow cytometry, base editing was also as efficient as spCas9 nuclease at generating B2M protein knockout.

Figure 20:
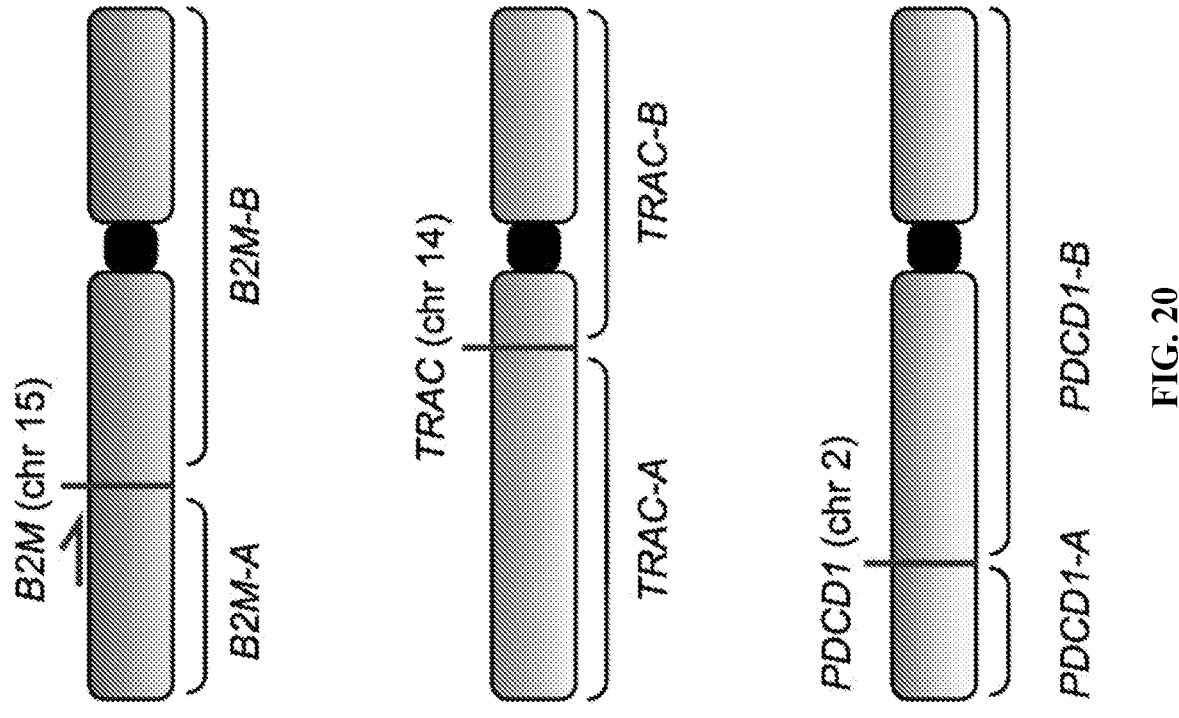
FIG. 20 is a schematic depicting the locations of B2M, TRAC, and PD-1 target sites. Translocations can be detected when B2M, TRAC, and PD-1 sequences recombine.

Example 8: Orthogonal Translocation Detection Assay Cannot Detect BE4-Induced Rearrangements in Triple-Edited T Cells Immune cells were co-transfected with mRNA encoding a BE4 base editor along with sgRNAs that targeted specific sites in B2M, TRAC, and PD1. The triple-edited T cells were evaluated using a translocation detection assay that was capable of detecting specific translocations that were undesirable between B2M, TRAC, and PD1 target genes (FIG. 20). Notably, none of these specific translocations were detected in any of the BE4-edited genes (Table 22). In contrast, Cas9-treated cells displayed low, but detectable levels of the translocations. Thus, multiplex editing of T cells using the BE4 base editor did not generate translocations in contrast to multiplex editing using Cas9 nuclease.

TABLE 22

| Type | Mock (%) | BE4-treated (%) | Cas9-treated (%) |
|---|---|---|---|
| On-target modification (B2M/TRAC/PDCD1) | 0 | 89.9/97.9/89.1 | 53.0/77.2/55.2 |
| B2M-A/TRAC-A | 0 | 0 | 0.925 |
| B2M-A/TRAC-B | 0 | 0 | 0.353 |
| B2M-A/PDCD1-A | 0 | 0 | 1.647 |
| B2M-A/PDCD1-B | 0 | 0 | 0.508 |
| B2M-B/TRAC-A* | 0 | 0 | 0.505 |

Figure 21:
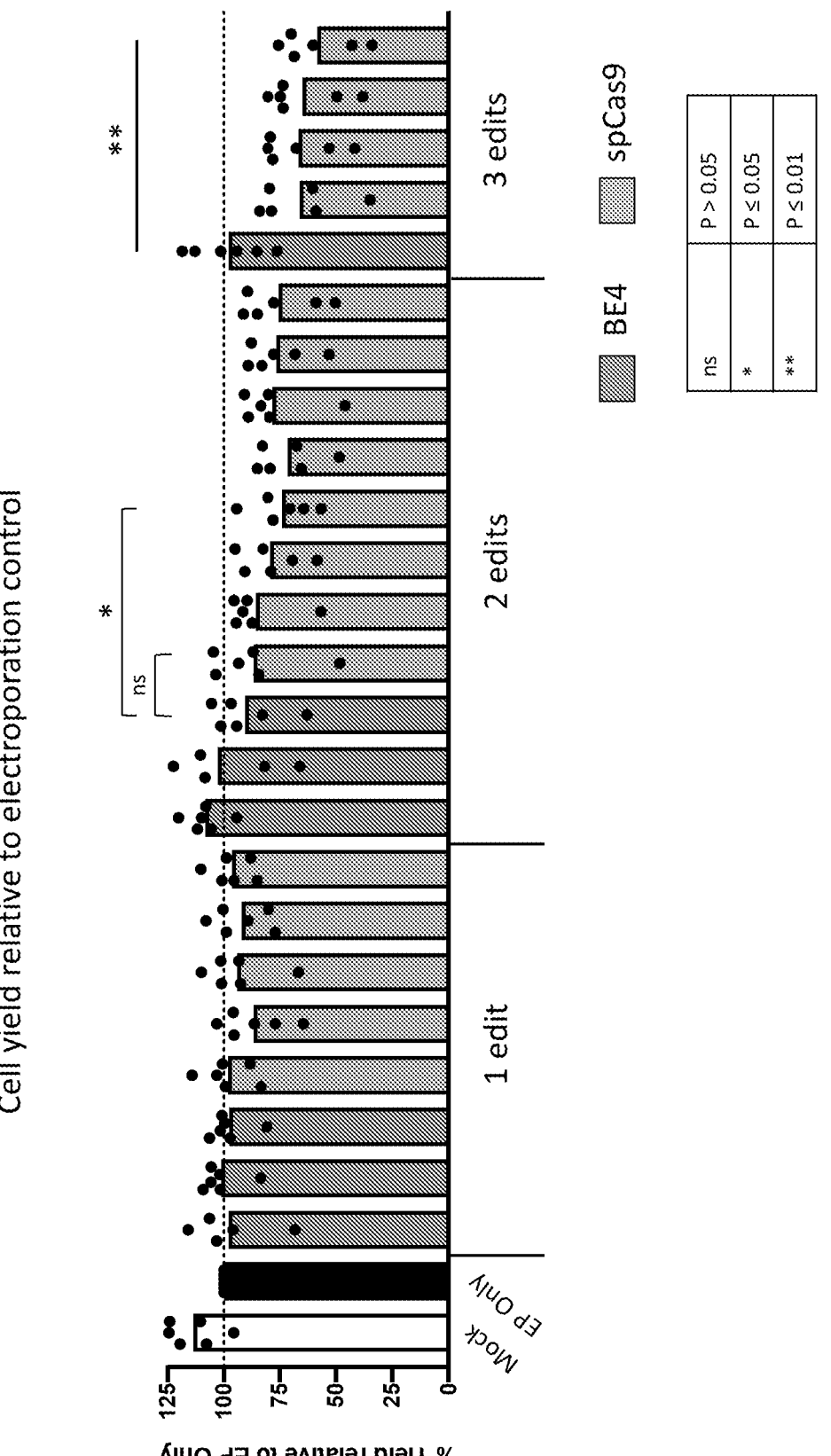
FIG. 21 is a graph showing that multiplexed base editing does not significantly impair cell expansion.

$LLoD_{BE4} = 0.1\%$
*B2M-B only measurable in this experiment if translocation includes a local rearrangement at the B2M locus Example 9: Multiplexed Base Editing does not Significantly Impair Cell Expansion An extensive guide screen was performed across B2M, TRAC, and PD1 targets with both BE4 and spCas9 sgRNAs. Guides were selected for high editing efficiency and expansion based on single-plex test. Final cell yields compared between 1, 2 and 3 edits using BE4 and spCas9 and were normalized to electroporation only control. BE4 edited cells with the desired edits displayed high yields when up to 3 edits were made (FIG. 21). In contrast, spCas9 edited cells showed reduced yields when increasing numbers of multiplex edits were made. Thus, multiplexed base edited cells maintained high cell expansion even when up to 3 edits were being made. Thus, BE4 generated multiplex-edited T cells with no detectable genomic rearrangements while also maintaining high cell expansion compared to spCas9 treated samples.

Example 10: BE4 Generated Triple-Edited T Cells with Similar On-Target Editing Efficiency and Cellular Phenotype as spCas9

Figure 22:
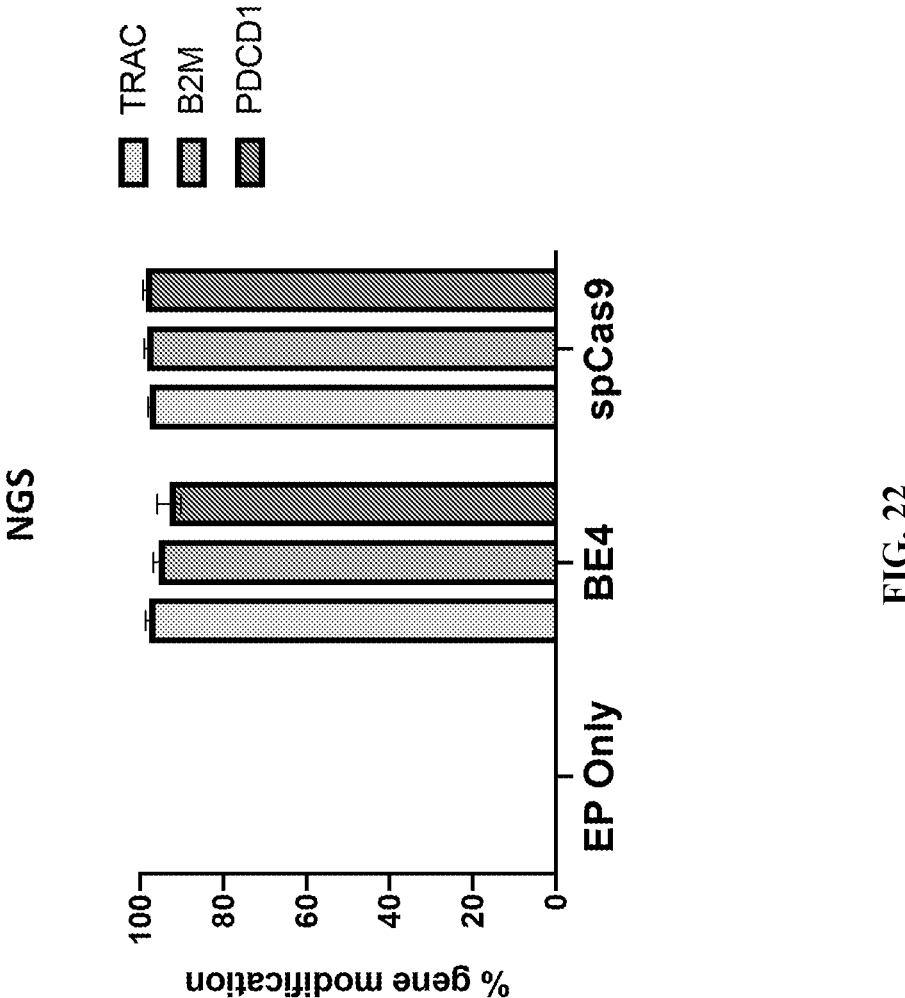
FIG. 22 is a graph showing that BE4 generated triple-edited T cells with similar on-target editing efficiency and cellular phenotype as spCas9.
Figure 23:
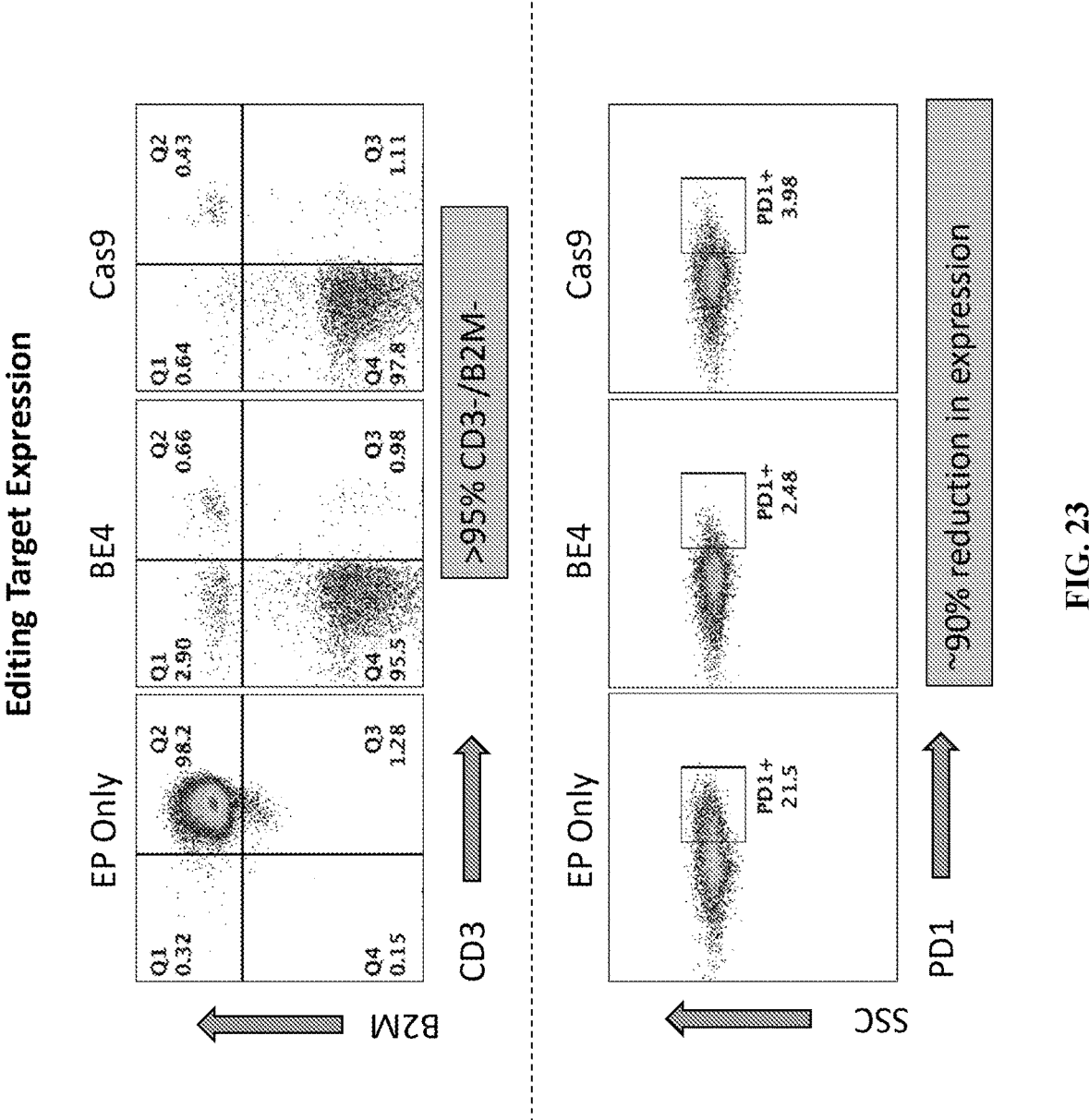
FIG. 23 depicts flow cytometry analysis showing the generation of triple-edited CD3-, B2M⁻, PD1⁻ T cells.

T cells were co-transfected with mRNA encoding a BE4 base editor along with sgRNAs that target specific sites in B2M, TRAC, and PD1. As shown by sequencing data, base editing was efficient at modifying cells at all three sites (FIG. 22). Modification of the genes by base editing was similar to that using spCas9 nuclease. Flow cytometry also showed decreased surface expression of B2M and CD3 (FIG. 23, upper panel). Compared to electroporation only control cells, BE4 and Cas9 multiplex edited cells displayed significant reductions of B2M and CD3 protein on the cell surface (>95% CD3-/B2M-). Although PD1 staining is less efficient, significant reductions (~90%) in PD1 were observed in BE4 and Cas9 multiplex edited cells compared to electroporation only control cells (FIG. 23, lower panel).

Figure 24:
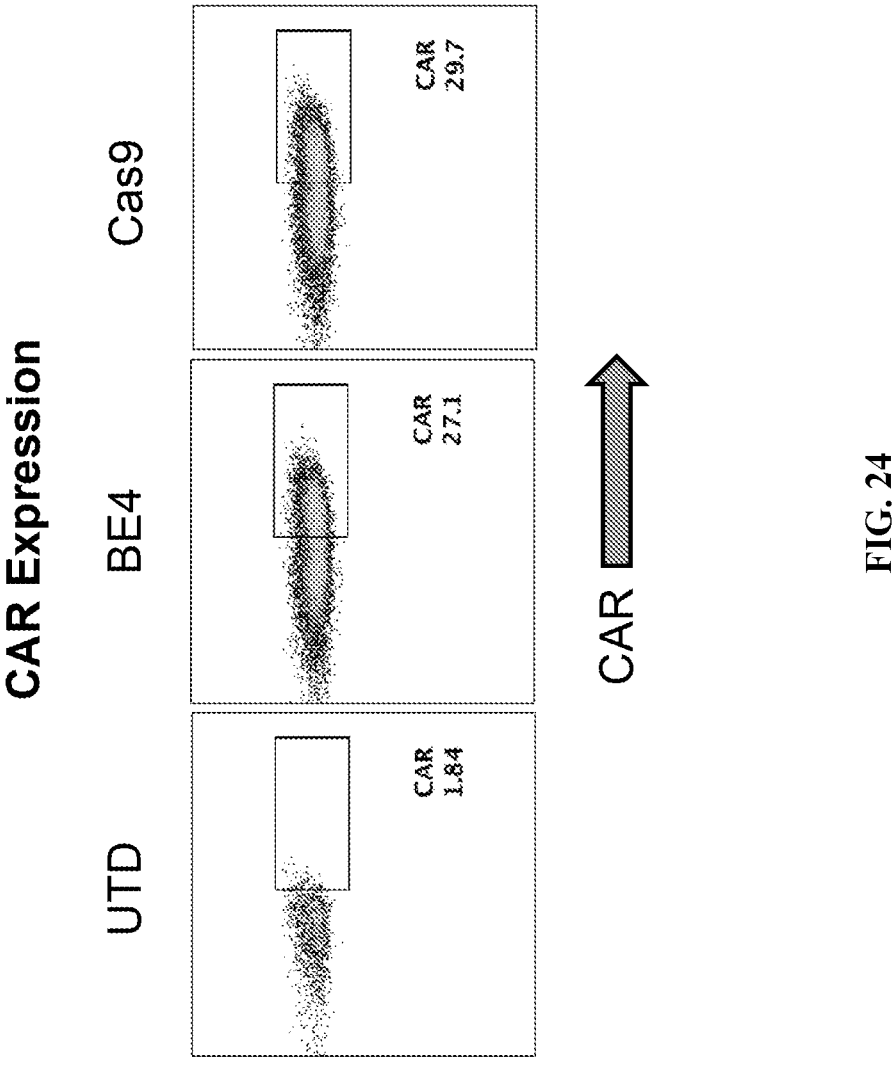
FIG. 24 depicts flow cytometry analysis showing the CAR expression in BE4 and Cas9 edited cells.
Figure 25:
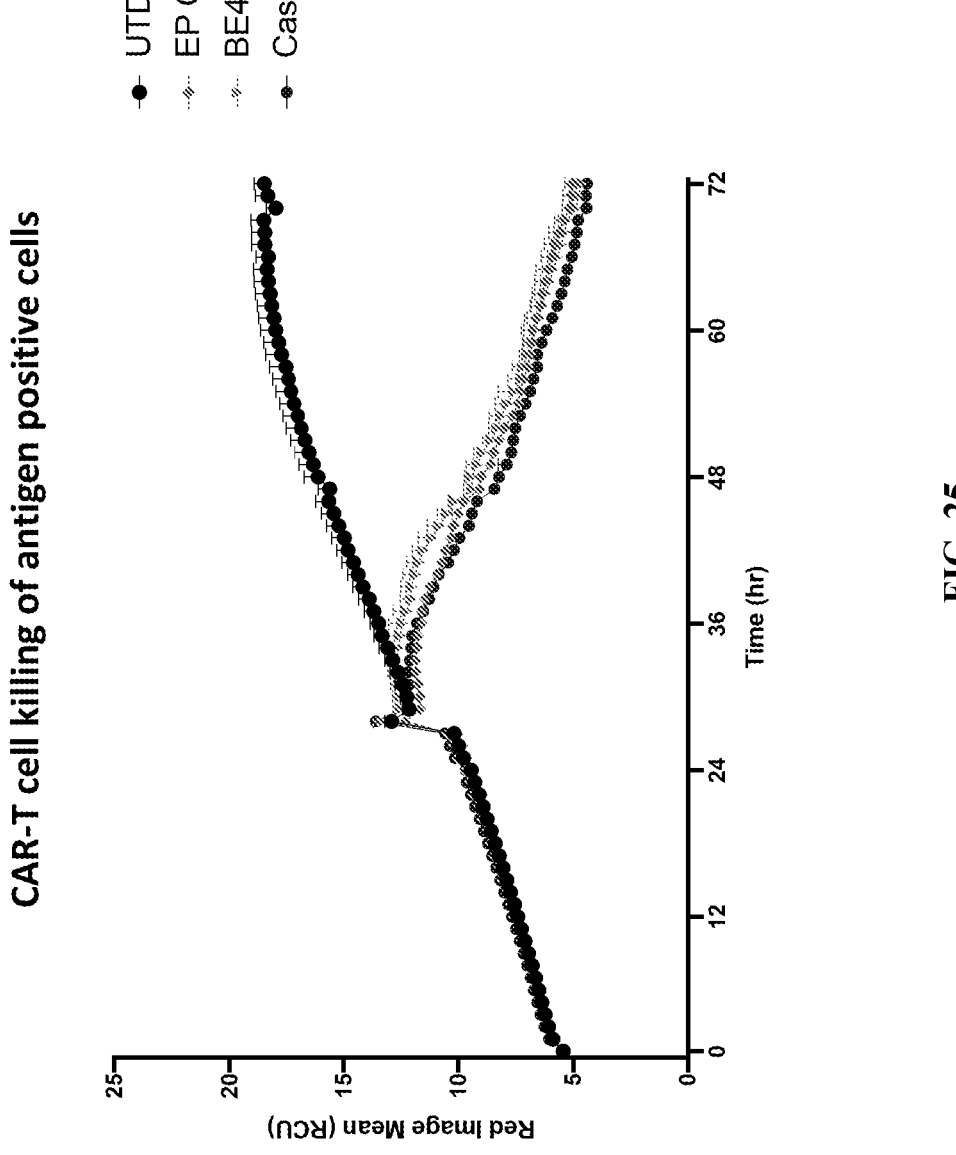
FIG. 25 is a graph showing CAR-T cell killing or antigen positive cells.

Example 11: BE4 Editing does not Alter CAR Expression or Antigen-Dependent Cell Killing T cells were co-transfected with mRNA encoding a BE4 base editor along with sgRNAs that target specific sites in B2M, TRAC, and PD1. A chimeric antigen receptor (CAR) targeting BCMA was introduced by integration of a lentiviral vector encoding the anti-BCMA CAR. CAR expression was observed by flow cytometry in BE4 and Cas9 edited cells (FIG. 24), compared to untreated cells that did not receive the lentiviral vector. The CAR-T cells were evaluated for cell killing by nuclear staining of the cells expressing BCMA and detecting loss of nuclear staining, indicating cell death. Antigen dependent cell killing was observed in cells transduced with the vector and expressing the CAR, including BE4 and Cas9 edited T cells (FIG. 25). In contrast, untreated cells that were not transduced with the vector did not display cell killing activity. Thus, BE4-generated CAR-T cells demonstrated comparable gene disruption, cell phenotype, and antigen-dependent cell killing compared to their nuclease-only counterparts.

Figure 26:
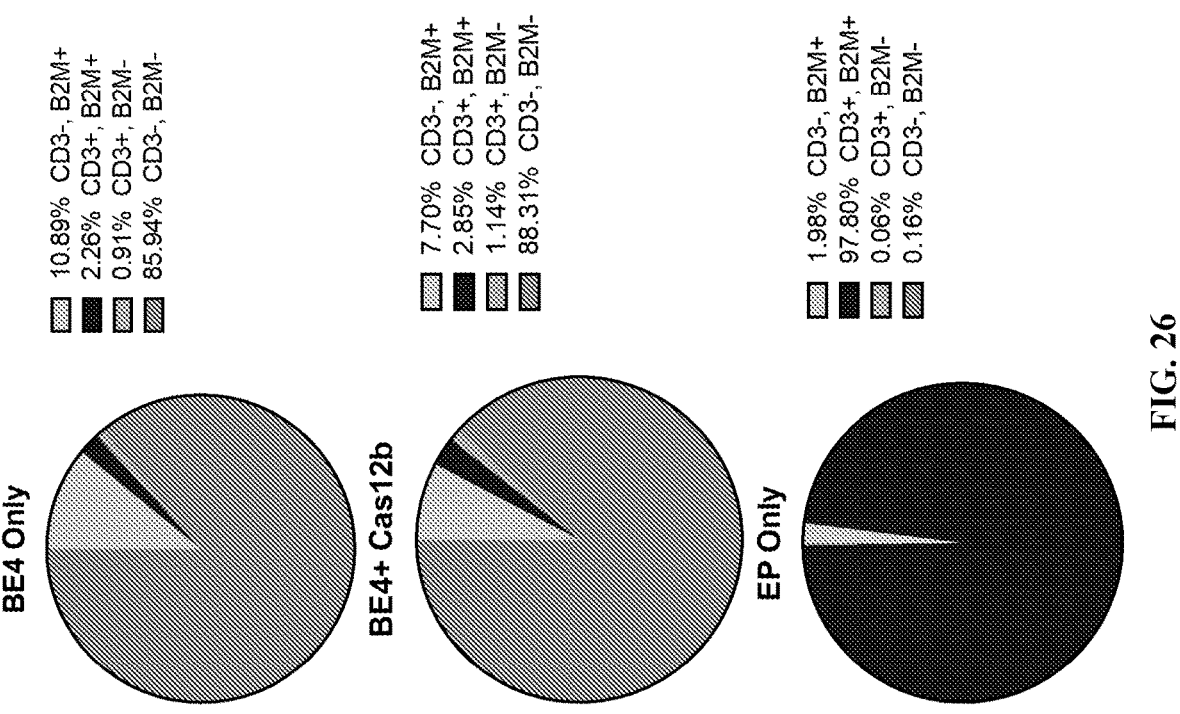
FIG. 26 are graphs showing that Cas12b and BE4 can be paired for efficient multiplex editing in T cells.

Example 12: Cas12b and BE4 can be Paired for Highly Efficient Multiplex Editing in T Cells CD3−, B2M− T cells were generated using BE4 only or using BE4 and Cas12b. For T cells generated using BE4 only, T cells were co-transfected with mRNA encoding a BE4 base editor along with sgRNAs that target specific sites in B2M and TRAC. For T cells generated using BE4 and Cas12b, T cells were co-transfected with mRNA encoding a BE4 base editor, and an sgRNA that targets a specific site in B2M, mRNA encoding BhCas12b (V4), and a Cas12b sgRNA that targets exon 4 of the TRAC gene, which was used to disrupt the TRAC gene. The resulting T cells were assessed using fluorescence assisted cell sorting (FACS) analysis to detect B2M and CD3 cell surface expression. Knockouts using BE4 only displayed a similar profile to those using BE4 and Cas12b. In particular, a high percentage of the T cells were CD3−, B2M−: 86% (BE4 only) and 88% (BE4+Cas12b), while the other possible phenotypes CD3−, B2M−; CD3+, B2M+ T cells; and CD3+, B2M− were represented less in the cell population (FIG. 26). In contrast, electroporation only control showed a population having a high percentage (97.8%) of CD3+ B2M+ cells and a very low percentage of CD3−, B2M− cells.

Figure 27:
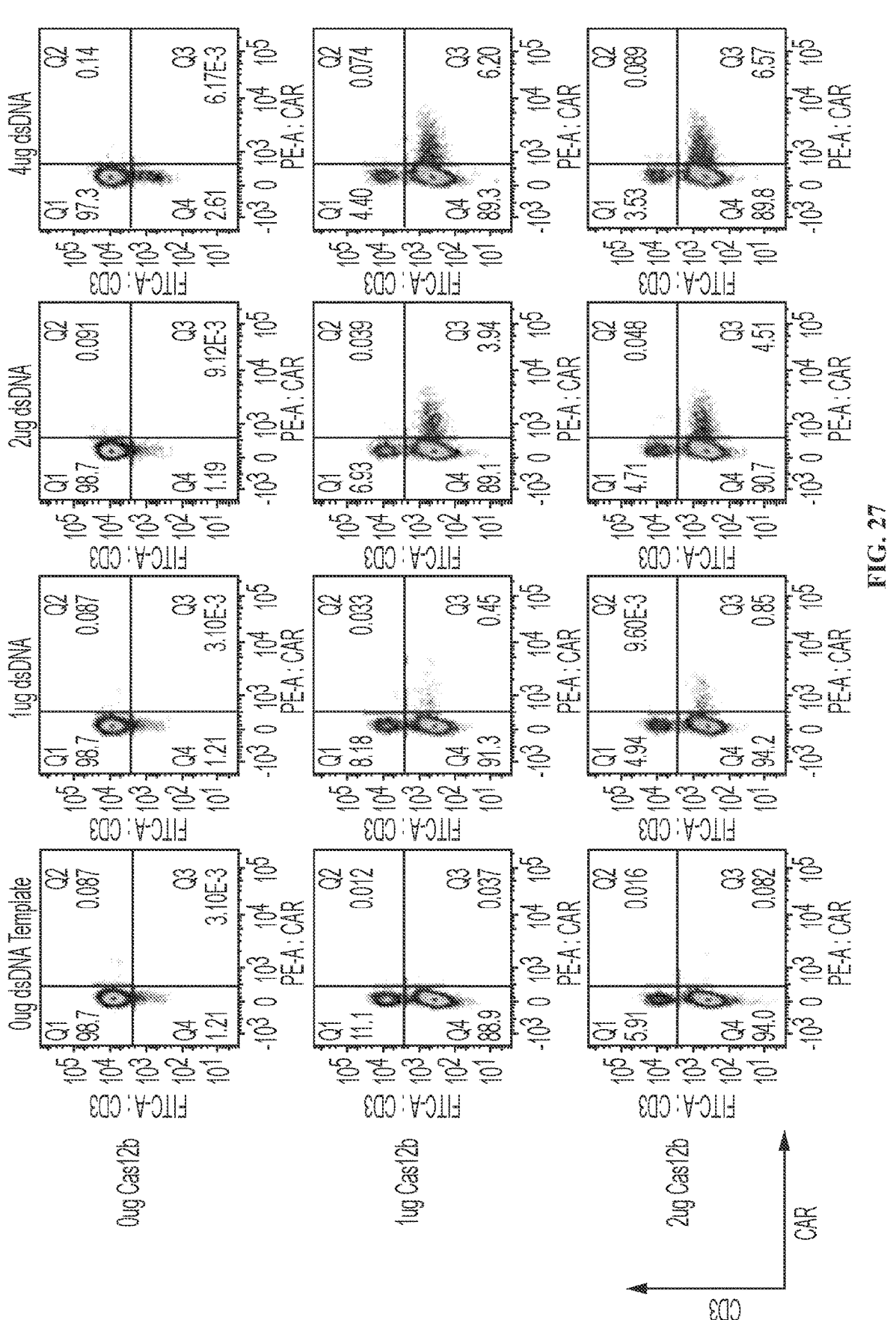
FIG. 27 is a graph showing that Cas12b can direct insertion of a chimeric antigen receptor (CAR) into a locus by introducing into a cell a double-stranded DNA template encoding the CAR in the presence of a Cas12 nuclease and a sgRNA targeting the locus.

Cas12b was used to generate CD3−, CAR+ T cells. T cells were co-transfected with mRNA encoding BhCas12b (V4), a Cas12b sgRNA that targets exon 4 of the TRAC gene, and a double-stranded DNA (dsDNA) donor template encoding an anti-BCMA CAR. T cells were assessed using fluorescence assisted cell sorting (FACS) analysis to detect CD3 and BCMA cell surface expression. When increasing amounts of Cas12b were introduced into the cell in the presence of the sgRNA, CD3 expression decreased, as seen by a shift in the cell population to the CD3− quadrant (FIG. 27). When increasing amounts of donor template and were introduced in the cells under the same conditions, a shift to CD3−, CAR+ quadrant was observed in the cell population.

Thus, Cas12b can be paired with BE4 to generate multiplex-edited T cells, minimizing genomic rearrangements caused by multiple double-strand breaks.

Example 13: In Vivo Efficacy in Animal Models

To determine the anti-oncogenic activity of the compounds described herein in vivo, the compounds are, for example, given alone (IP, IV, PO, by inhalation or nasal routes) or in combination with sub-optimal doses of relevant chemotherapy (e.g., cyclophosphamide, doxorubicin, etoposide). In one example, $5\times10^6$ RS4; 11 cells (established from the bone marrow of a subject with acute lymphoblastic leukemia) that stably express luciferase are injected by tail vein in NOD-SCID mice 3 hours (hrs) after they have been subjected to total body irradiation. If left untreated, this form of leukemia is fatal in 3 weeks in this model. The leukemia is readily monitored, for example, by injecting the mice with D-luciferin (60 mg/kg) and imaging the anesthetized animals (e.g., Xenogen In Vivo Imaging System, Caliper Life Sciences, Hopkinton, MA). Total body bioluminescence is quantified by integration of photonic flux (photons/sec) by Living Image Software (Caliper Life Sciences, Hopkinton, MA). Compounds described herein alone or in combination with sub-optimal doses of relevant chemotherapeutics agents are, for example, administered to leukemic mice (10 days after injection/day 1 of experiment, in bioluminescence range of 14-16) by tail vein or IP routes at doses ranging from 0.1 mg/kg to 50 mg/kg for 7 to 21 days. Optionally, the mice are imaged throughout the experiment every other day and survival monitored daily for the duration of the experiment. Expired mice are optionally subjected to necropsy at the end of the experiment. Another animal model is implantation into NOD-SCID mice of DoHH2, a cell line derived from a human follicular lymphoma that stably expresses luciferase. These in vivo tests optionally generate preliminary pharmacokinetic, pharmacodynamic and toxicology data.

Example 14: Clinical Trials

To determine the suitability of the compounds described herein for treatment of humans, clinical trials are performed. For example, subjects diagnosed with liquid cancer and in need of treatment can be selected and separated in treatment and one or more control groups, wherein the treatment group is administered a compound described herein, while the control groups receive a placebo or a known anti-cancer drug. The treatment safety and efficacy of the compounds described herein can thus be evaluated by performing comparisons of the subject groups with respect to factors such as survival and quality-of-life. In this example, the subject group treated with a compound described herein can show improved long-term survival compared to a subject control group treated with a placebo.
Study Design
This study comprises a dose-escalation, 2-arm study designed to evaluate the safety, tolerability, PK, PD, and anti-liquid cancer cell effects of a compounds administered by IV infusion using 2 different dosing regimens of a 28- or 21-day cycle, in subjects with advanced liquid cancer (e.g., leukemia, myeloma, or liquid lymphoma) expressing WT p53 protein. For example, a compound described herein can be used in subjects with relapsed/refractory acute myeloid leukemia (AML) and/or acute lymphoid leukemia (ALL). Subjects receive a compound described herein either once weekly for three consecutive weeks for a 28-day cycle or twice weekly for two consecutive weeks for a 21-day cycle. Many subjects with a liquid lymphoma present circulating tumor cells (CTC) in peripheral blood, which can be detected and analyzed using flow cytometry. Thus, detection of study drug-specific target engagement in these cells is possible.
The study consists of a Dose Escalation Phase (DEP) and an Expansion Phase (EXP). The DEP is a "3+3" dose escalation design to establish the MTD or OBD of a compound described herein. The EXP enrolls up to 2 distinct groups of subjects with specific liquid cancers at the MTD or OBD to further investigate the clinical safety profile and potential efficacy of the dose level. The selection of subjects for the EXP is finalized based on results of the DEP, as well as data from additional nonclinical pharmacology studies. The later includes the investigation of multiple liquid cancer cell lines (e.g., leukemia, liquid lymphoma, myeloma, etc.) that facilitate the comparison of cell line sensitivity to a compound described herein across and within liquid cancer types.

Treatment of subjects in the dose escalation and the dose expansion phases of the study continues until documentation of disease progression, unacceptable toxicity, or subject or physician decision to discontinue therapy.

After the MTD or OBD is established, additional subjects can be enrolled in up to two separate expansion cohorts (approximately 30 subjects per expansion cohort to gain further experience at this dose level and in particular subject or liquid cancer cell types. Selection of subject or liquid cancer cell types is determined in part on the basis of observations made in the dose escalation portion of the study.

Safety is evaluated based on the incidence, severity, duration, causality, seriousness, and type of Adverse Event (AE), and changes in the subject's physical examination, vital signs and clinical laboratory results. Investigators use the NCI CTCAE version 4.0 to assess the severity of AEs.

Because the primary objectives of this study are based on safety and PK, statistical analyses are descriptive in nature and accounts for all doses studied and all observed responses, including subjects who achieve a complete response (CR) or partial response (PR) or who maintain stable disease (SD) based on IWG (2014) criteria. Subjects who receive at least one dose of a compound described herein constitute the safety population and are included in all safety analyses. Subjects who complete at least one cycle of a compound described herein and undergo a post-treatment objective disease assessment constitute the efficacy-evaluable subject population.

Example 15: Exemplary Methods of Identifying and Silencing Genes

Figure 28A:
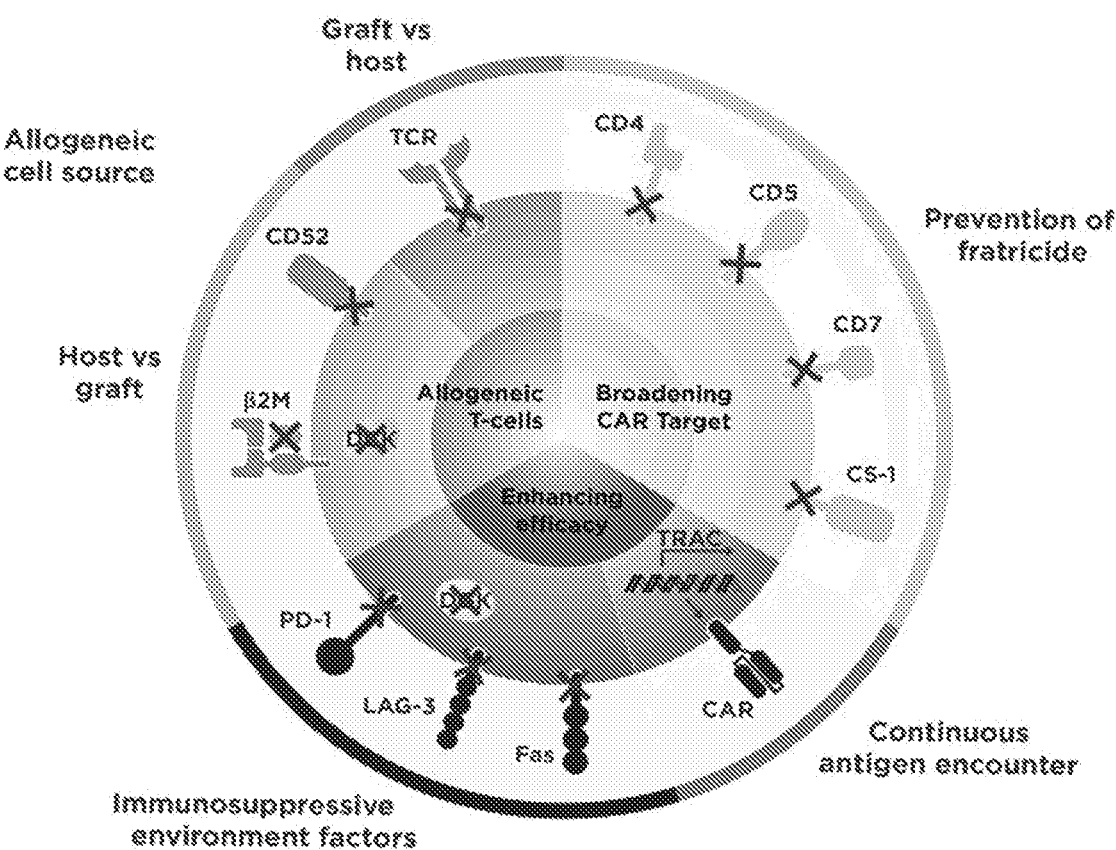

In this Example, methods for gene silencing of targets for CAR-T are provided. FIG. 28A provides a diagram of genes to be targeted and considerations with respect to same. Targets include, for example, one or more of CD4, CD5, CD7, CS-1, TRAC, CAR, FAS, LAG-3, PD-1, β2M, CD52 and TCR.

There are two strategies for silencing with base editors. The first strategy assesses the target protein and then changes one or more of glutamine, arginine, or tryptophan to a stop codon to silence protein expression (see, item 1 of FIG. 28B). The second strategy involved splice disruption with CBE (see, item 2 of FIG. 28B) to silence protein expression.

Example 16: Multiple CAR-T Populations are Used to Address Clonality of Disease in AML or T-ALL It is contemplated that leukemias become resistant or relapse in light of certain therapies due to the disease's evolution through reiterative process of clonal expansion and selection due to selection pressures in the tumor microenvironment. As an example, different clones of AML cancer cells can exhibit various antigens, such as CD33+ CD123−; CD33+CD123+, or CD33− CD123+. A therapeutic agent targeting CD33+ cancer cells would not address cells lacking in this particular antigen, such as CD33− CD123+. It is therefore contemplated that multiple CAR-T cell populations described herein address the clonality of disease.

Figure 29:
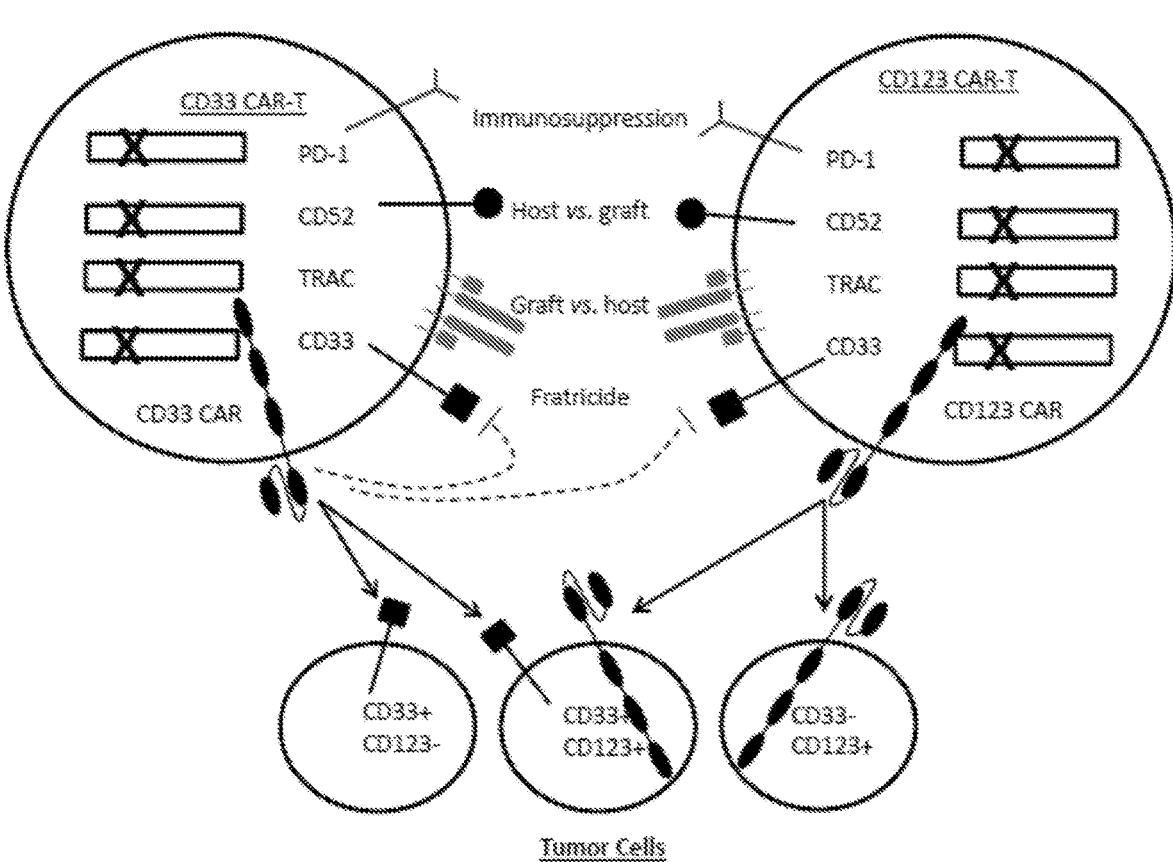
FIG. 29 is an illustrative cartoon representation that, in some cases, Multiple CAR-Ts required to address clonality of disease in AML.

In an exemplary method, CD33 and CD123 CAR-T cells are generated as illustrated in FIG. 29. The CD33 and CD123 CAR-T cells are administered to an AML patient having markers for CD33+CD123+ AML. The CD33 and CD123 CAR-T cells eliminate AML cancer cells in the patient that are CD33+ CD123−, CD33+CD123+, and CD33−CD123+.

Figure 30:
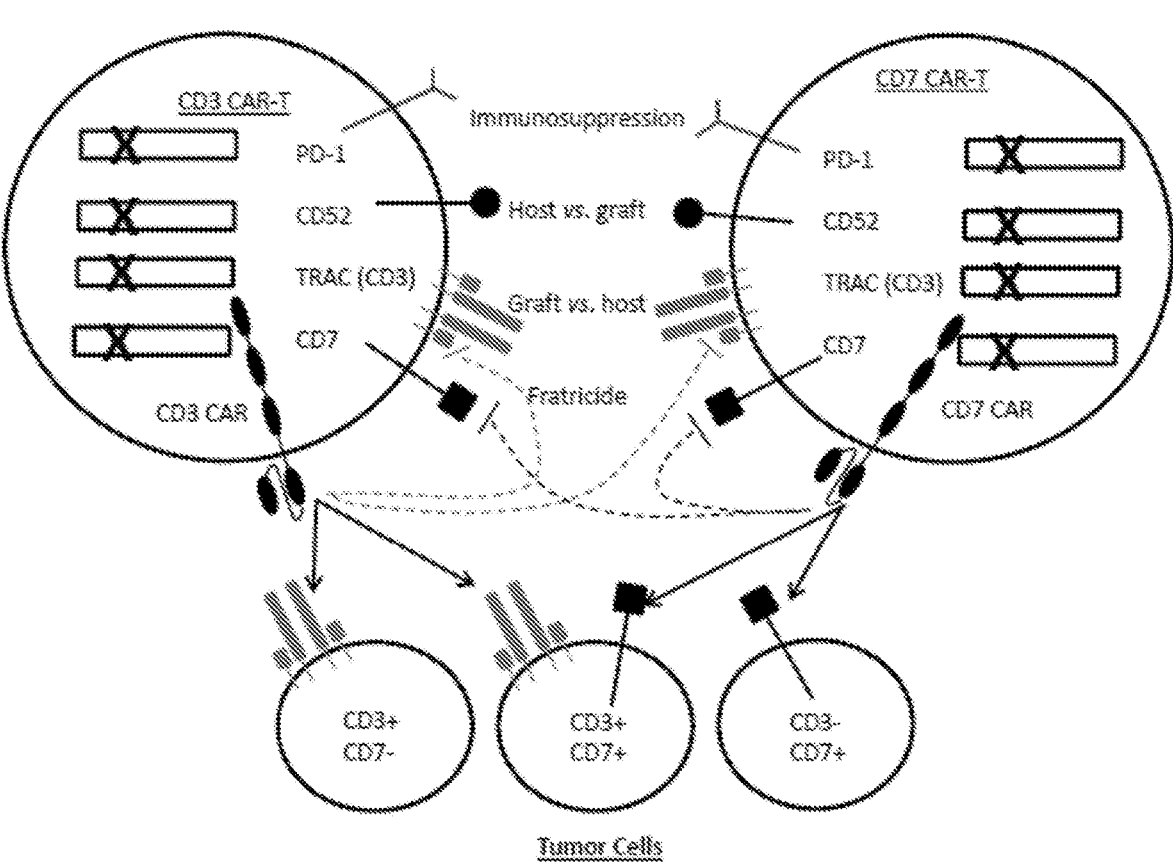
FIG. 30 is an illustrative cartoon representation that, in some cases, multiple edits may be required to eliminate fratricide for a T-ALL CAR-T combination.

In another exemplary method, CD3 and CD7 CAR-T cells are generated as illustrated in FIG. 30 by the methods described herein. The CD3 and CD7 CAR-T cells are administered to a T-ALL patient having markers for CD3+ CD7+ T-ALL. The CD3 and CD7 CAR-T cells eliminate T-ALL cancer cells that are CD3+ CD7−, CD3+CD7+, and CD3−CD7+.

Example 17: Multiple CAR-T Populations are Modified to Eliminate Fratricide

A major limitation of traditional T cell and CAR-T therapies is that the activated cells may undergo self-killing or fratricide during cell manufacturing, storage, or when infused in patients. To avoid fratricide, the CAR-T cells described herein are modified to comprise a mutation in a polynucleotide encoding an antigen that the cell's CAR is specific to. As an example, CD7 CAR-T cells are modified to comprise a mutation in CD7 polynucleotide to prevent fratricide. As another example, CD3 CAR-T cells are modified to comprise a mutation in CD3 polynucleotide to prevent fratricide. In multiple CAR-T populations, additional modifications are performed to prevent cross-fratricide (i.e., mutations in both CD3 and CD7 polynucleotides in both CAR-T populations). Additional modifications include mutations to genes that may be involved in immunosuppression, graft versus host, host versus graft, and the like.

In an exemplary method, CD33 and CD123 CAR-T cells for the treatment of AML are generated as illustrated in FIG. 29. Both CD33 and CD123 CAR-T cells are modified to have a mutation in CD33 so that cells do not target themselves. Additional mutations in PD-1, CD52 and TRAC reduce or prevent immunosuppression, host versus graft and graft versus host, respectively.

In an exemplary method, CD3 and CD7 CAR-T cells for the treatment of T-ALL are generated as illustrated in FIG. 30. Both CD3 and CD7 CAR-T cells are modified to have mutations in CD3 (TRAC) and CD7 so that cells do not target themselves or the other population. Additional mutations in PD-1, CD52 and TRAC reduce or prevent immunosuppression, host versus graft and graft versus host, respectively.

Figure 31A:
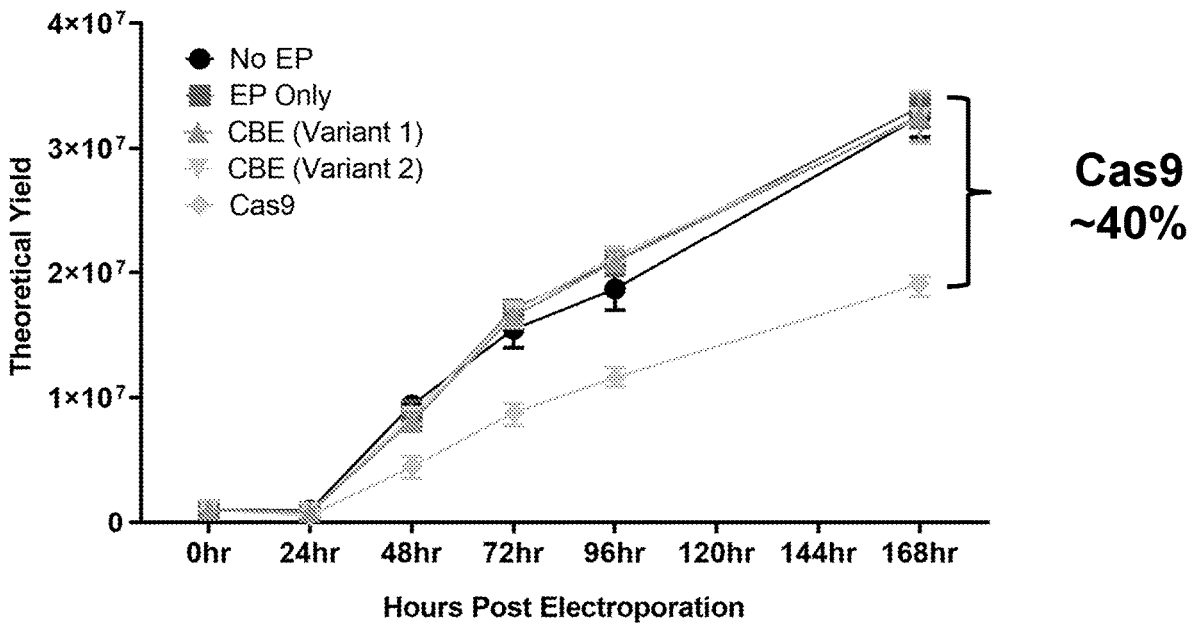
FIGS. 31A-B illustrate the results of experiments testing four simultaneous base edits for T-ALL; CAR-T does not impact yield compared to nuclease.
Figure 31B:
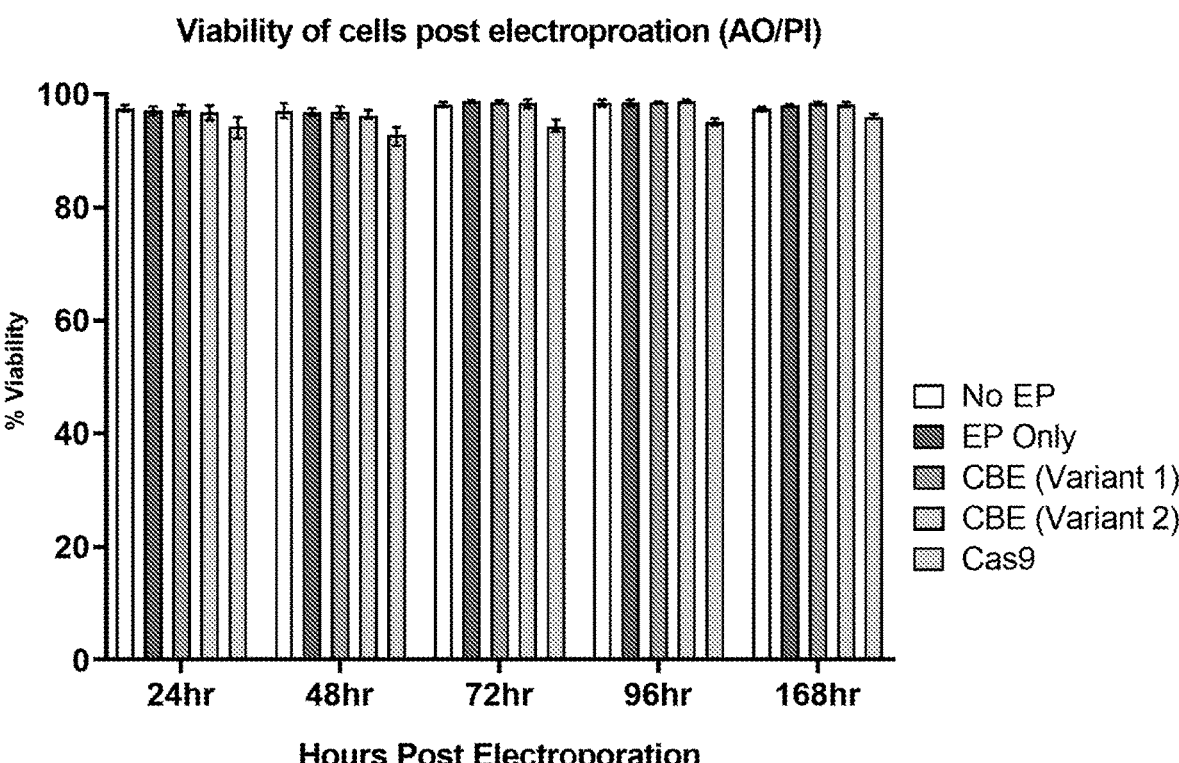

Example 18: Four Simultaneous Base Edits for T-ALL CAR-T Cell does not Impact Yield Compared to Nuclease The theoretical yield in the context of quad-T-ALL edits is determined in an assay in which the following components are tested. Controls are no electroporation (no EP), EP only, CBE Variant 1, CBE Variant 2, and Cas9. Results are shown in FIG. 31A and the corresponding viability results are shown in FIG. 31B. It was determined that four simultaneous base edits for T-ALL CAR-T does not impact yield compared to nuclease.

Example 19: Scaled-Up Lonza Electroporation Induces Highly Efficient, Multiplex T Cell Base Editing for T-ALL CAR-T Cell Program T cells were cultured for 3 days post activation. $5×10^6$ cells were electroporated with 10 µg mRNA for editor (CBE 1, CBE 2, or spCas9) and 5 µg of sgRNA for the T-ALL guides (TRAC, CD52, CD7, PD1). Suitable guides are provided in Table 23 below:

TABLE 23

| Guide RNAs for T-ALL CAR-T | | |
| --- | --- | --- |
| Guide RNA (gRNA) | Guide Nucleic Acid Sequence | SEQ ID NO: |
| TRAC gRNA | ususcsGuAuCUGUAAAACCAAGGU UUUAGAGCUAGAAAUAGCAAGUUAA AAUAAGGCUAGUCCGUUAUCAACUU GAAAAAGUGGCACCGAGUCGGUGCU suSUSU | 1452 |
| CD52 gRNA | ususasCCUGUACCAUAACCAGGGU UUUAGAGCUAGAAAUAGCAAGUUAA AAUAAGGCUAGUCCGUUAUCAACUU GAAAAAGUGGCACCGAGUCGGUGCU sususu | 1453 |
| CD52 gRNA | CSUscSUUACCUGUACCAUAACCGU UUUAGAGCUAGAAAUAGCAAGUUAA AAUAAGGCUAGUCCGUUAUCAACUU GAAAAAGUGGCACCGAGUCGGUGCU sususu | 1454 |
| CD7gRNA | usgscsACCUCUGGGGAGGACCUGU UUUAGAGCUAGAAAUAGCAAGUUAA AAUAAGGCUAGUCCGUUAUCAACUU GAAAAAGUGGCACCGAGUCGGUGCU suSUSU | 1455 |
| CD7 gRNA | cscsusACCUGUCACCAGGACCAGU UUUAGAGCUAGAAAUAGCAAGUUAA AAUAAGGCUAGUCCGUUAUCAACUU GAAAAAGUGGCACCGAGUCGGUGCU suSUSU | 1456 |
| PD1gRNA | csascsCuACCUAAGAACCAUCCGu UuUAGAGCUAGAAAUAGCAAGUUAA AAUAAGGCUAGUCCGUUAUCAACUU GAAAAAGUGGCACCGAGUCGGUGCU SUSUSU | 1457 |

2'-O-methyl analogs and 3' phosphorothioate internucleotide linkages are used at the first three 5' and 3' terminal RNA residues, chemical modifications at each end indicated by "s" following the nucleotide.

CBE 1 refers to rat-APOBEC-BE4, and CBE2 refers to orangutan "BE4" (ppAPOBEC). No EP and EP only were controls that either got no zap or a zap without editor/guide.

Figure 32:
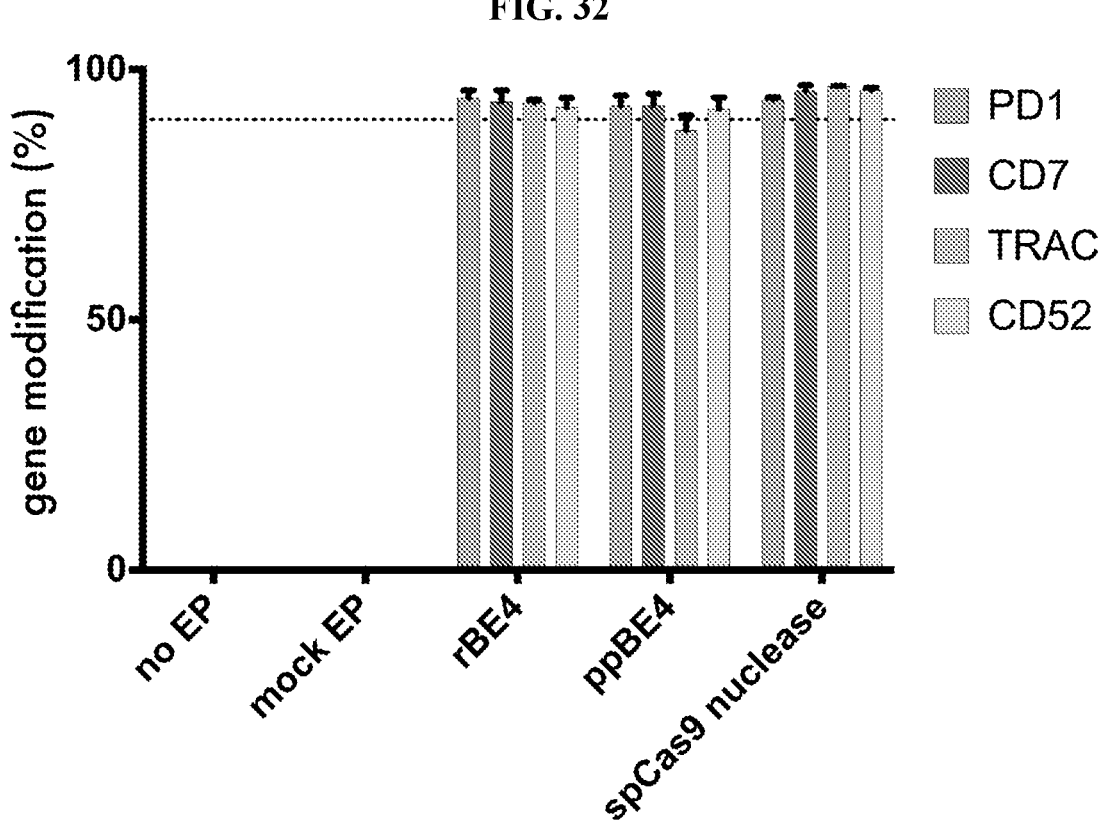
FIG. 32 illustrates that greater than 90% quad knockout by BE4. Electroporation was conducted at a 5M cell scale and the quad edit was performed in a single electroporation (EP) step. Greater than 90% edit efficiency was achieved for all 4 targets with rBE4. For each result group, data is from left to right: PD1, CD7, TRAC, and CD52.

Theoretical yield was measured as follows: cells were counted daily, with viability measurements using AO/DAPI staining (with viability readouts also performed with the count-AML figure with hours post EP viability readout). Cells were split back each day to $0.5×10^6$ cells/mL (theoretical because split and did not actually expand all cells). Calculations were made to determine what the theoretical yield would have been if the cultures had not been backsplit. The percentage of gene modification was determined (FIG. 32).

Figure 33:
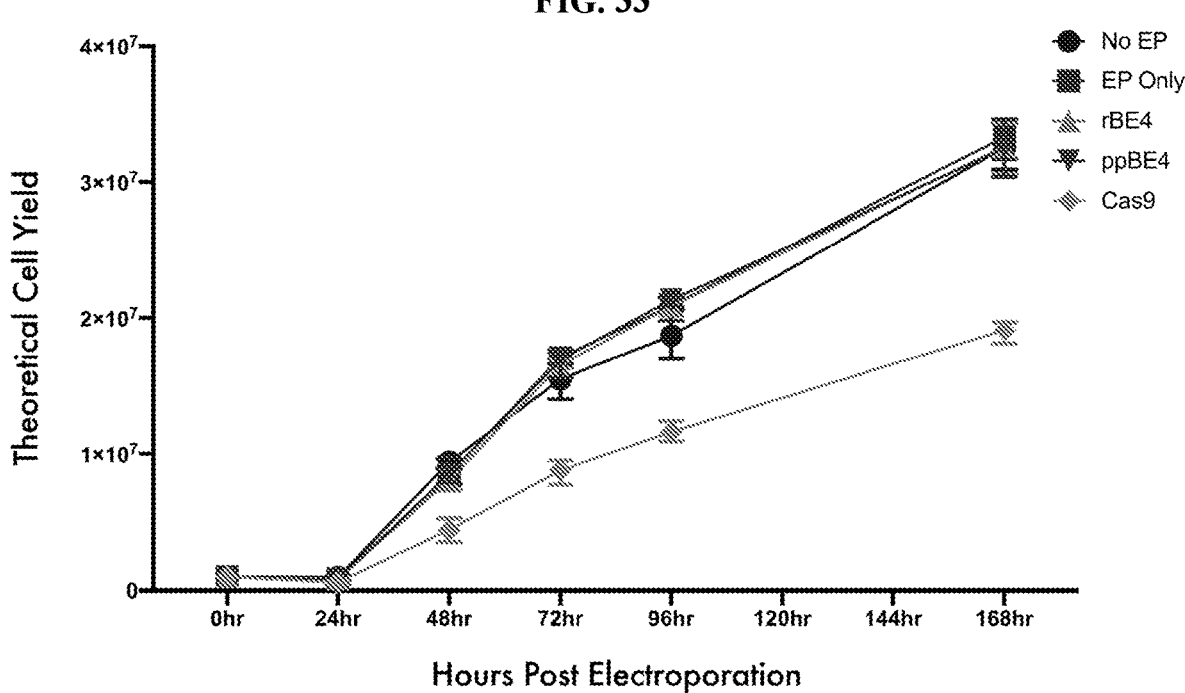
FIG. 33 illustrates that base editing causes no difference in cell yields. Data is: no EP (circles), EP only (squares), rBE4 (triangles), ppBE4 (upside down triangles), and Cas9 (diamonds).

Cells were taken through NGS and theoretical cell yield determined (FIG. 33).

Figure 34:
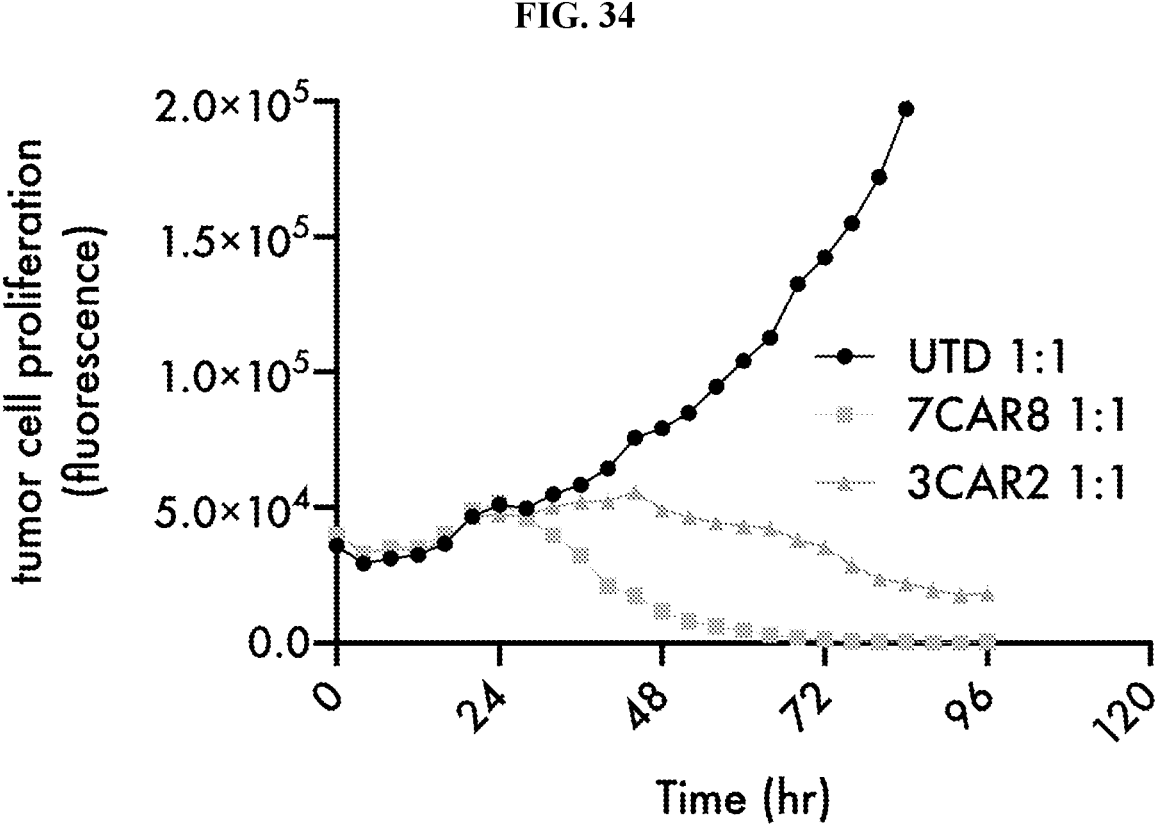
FIG. 34 illustrates that edited CAR-Ts target CD3 and CD7 on model tumor cells. Data is: UTD 1:1 (circles), 7CAR8 1:1 (squares), and 3CAR2 1:1 (triangles).

Cell killing demonstrated by loss of fluorescence marker in model tumor cells (FIG. 34).

All of the CARs tested comprise a binder clone in either heavy to light (H2L) or light to heavy (L2H) orientations, followed by a CD8a Hinge, CD8 transmembrane, and a CD28z signaling domain.

Example 20: Exemplary CAR-T Cell Process Flow and Contract Manufacturing

Frozen apheresis leukopak from healthy donors are obtained and thawed using Pasmatherm according to manufacturer's instructions. CD4 and CD8 T-cells are isolated using, for example, CliniMACS Prodigy according to manufacturer's instructions. The T cells are then activated using TransAct according to manufacturer's instructions. Electroporation delivery of mRNA/RNP base editors occurs using Lonza 4D Nucleofactor according to manufacturer's instructions to knock out CD3, CD7, CD52 and/or PD1. Depletion of TCR a/0 is conducted using art-recognized techniques. The T-cells are expanded and lentivirus transduction of 3CAR and 7CAR occurs. CAR-T cells are cryopreserved with control rate freezers (CRF).

Example 21: Treatment of T-ALL with CAR-T Cells

T-cell acute lymphoblastic leukemia (T-ALL) is an aggressive malignant neoplasm of the bone marrow. About 12-15% of ALL cases are diagnosed in children. Post-relapse 5 year survival is less than 25%. The standard of care is to use chemotherapy to induce a second remission followed by allogeneic hematopoietic stem cell transplantation (alloHSCT). However, many patients are refractory to chemotherapy or have high tumor burden and are not able to induce deep remission as a bridge for alloHSCT. Moreover, heavily pretreated patients are often not candidates for autologous CAR-T treatment. Accordingly, alternative treatment options are needed for the treatment of T-ALL.

Figure 35:
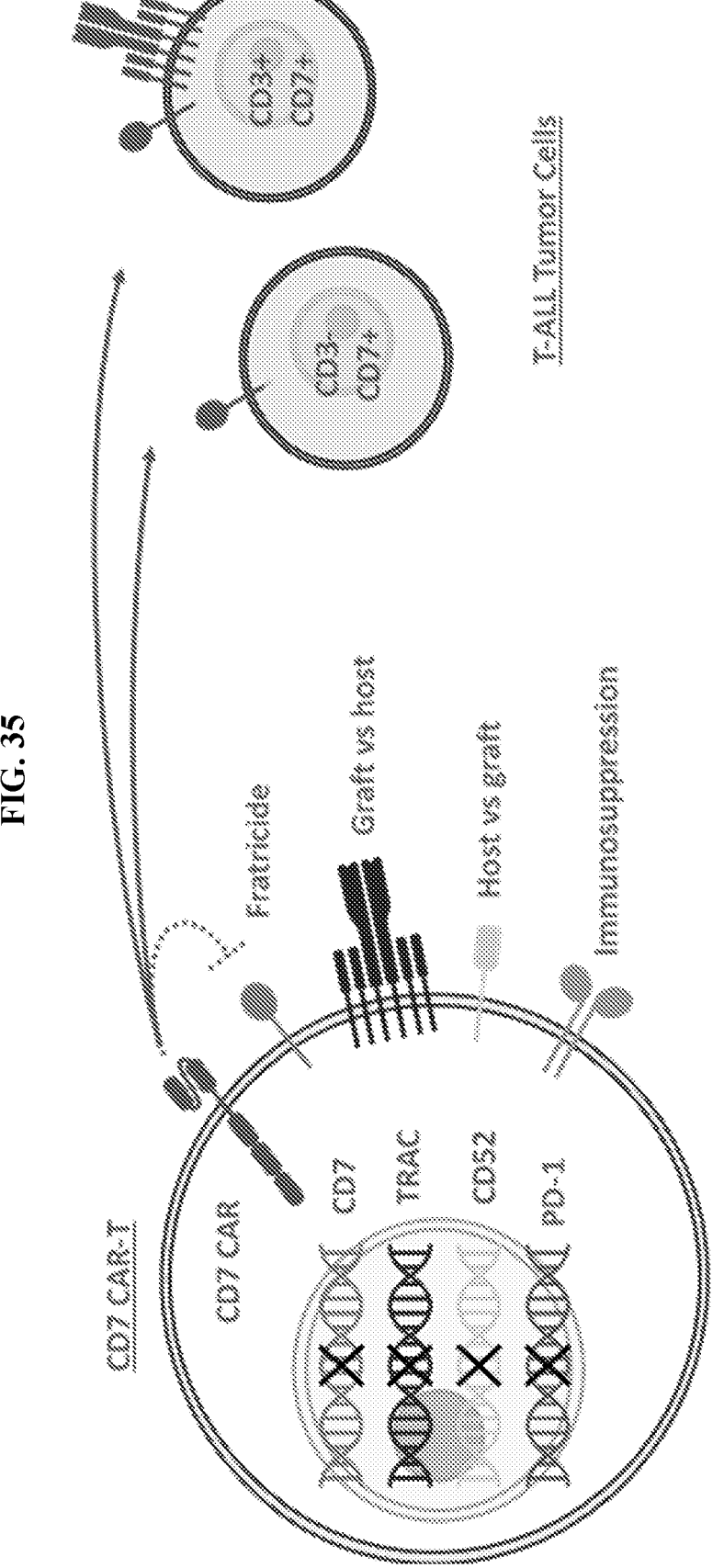
FIG. 35 is a schematic drawing of an exemplary CD7 CAR-T cell for targeting T-ALL Tumor cells.
Figure 36:
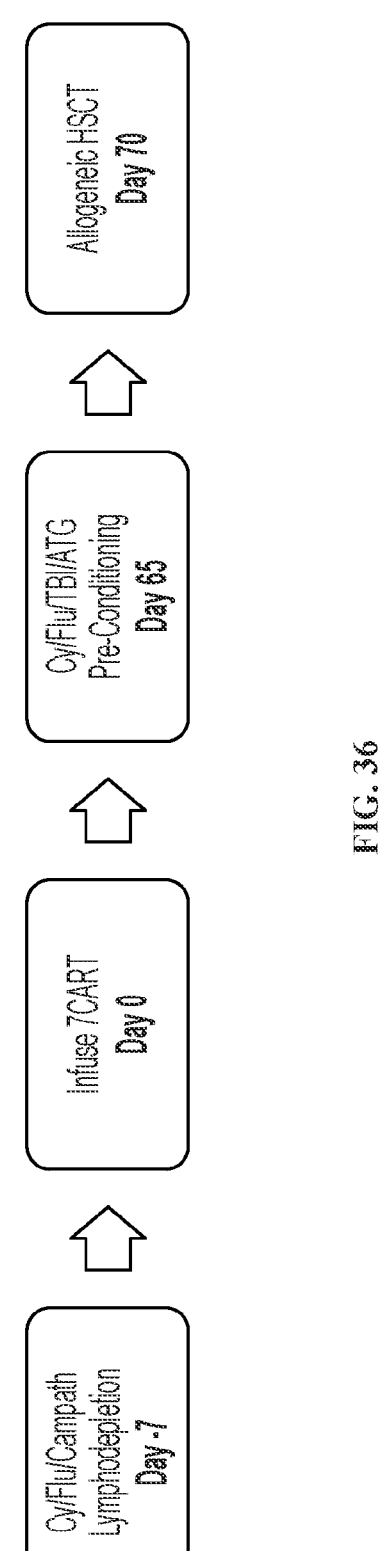
FIG. 36 is a flow chart depicting a clinical protocol for treating patients with CD7 CAR-T cells.

To examine whether edited CAR-T cells can induce deep remission in patients in order to bridge treatment with alloHSCT, multiplex editing was used to create a fratricide resistant CAR− T cell. As shown in FIG. 35, a T-cell expressing a CD7 chimeric antigen receptor was edited to reduce or eliminate expression of CD7, TRAC, CD52, and PD-1 for targeting $CD3^- CD7^+$ or $CD3^+ CD7^+$ T-ALL tumor cells. As shown in FIG. 36, lymphodepletion was conducted in about 20-30 T-ALL patients with Cy/Flu/Campath at day −7. At day 0, patients were infused with CD7 CAR-T cells. The patients were then pre-conditioned with Cy/Flu/TBI/ATG at day 65. On day 70, patients received treatment with alloHSCT. It is expected that treatment with CD7 CAR-T cells induces T cell aplasia and allows T-ALL patients to be treated with alloHSCT without a bridge treatment.

Example 22: Producing CD7 CAR-T Cells

Figures 37A, 37B:
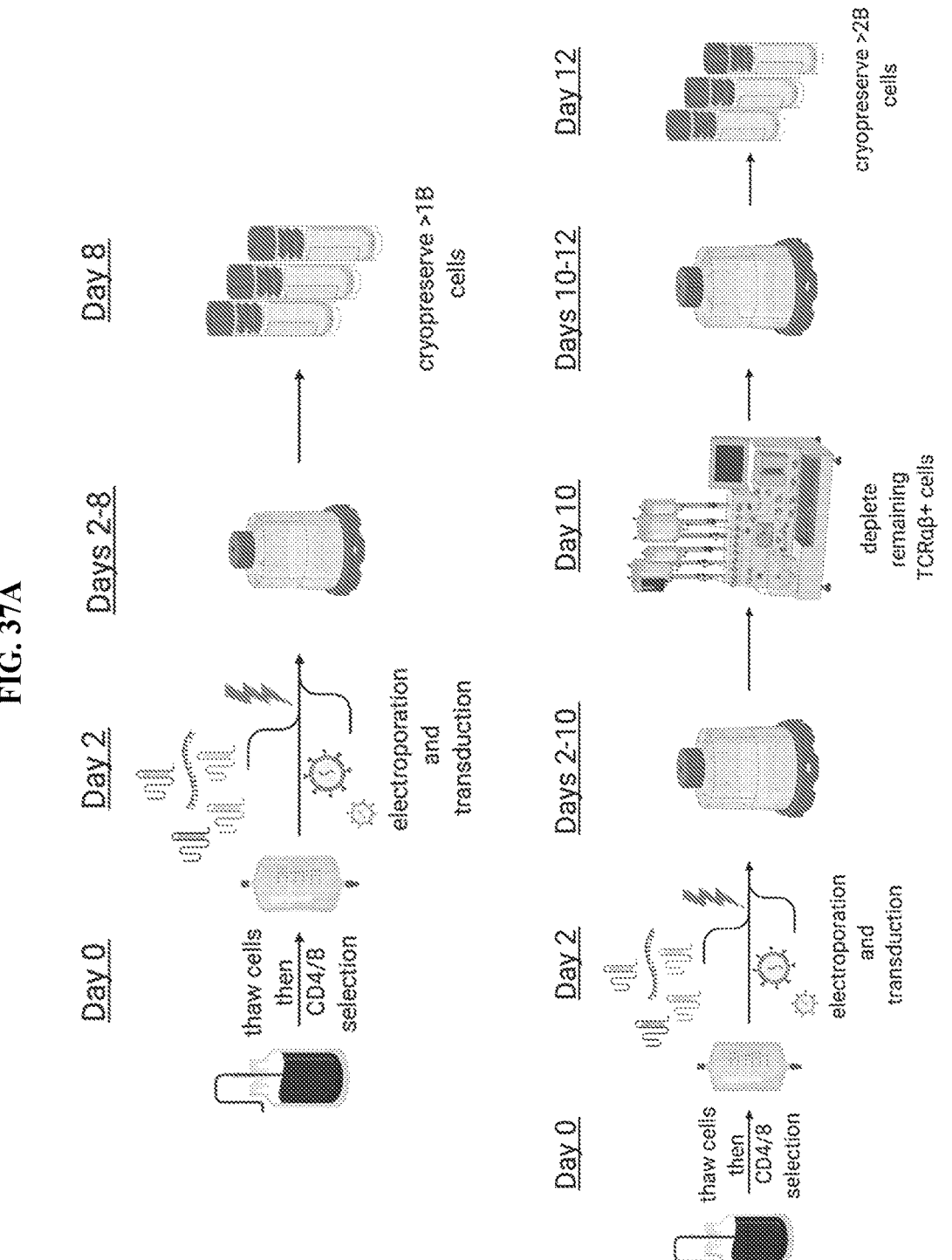
FIGS. 37A-37C depict CD7 CAR-T cell production.

To produce TALL017 CD7 CAR-T cells as shown in FIG. 37A, frozen apheresis was received from healthy donors. The apheresis was then thawed with Plasmatherm (Barkey GmbH & Co. KG). CD4 and CD8 T-cells were isolated from the thawed apheresis using CliniMACS Prodigy (Miltenyi Biotec). On Day 2, mRNA base editors and guide RNA were delivered into the T-cells by electroporation using Lonza SD Nucleofector. Following base editing, a CD7 chimeric anti-gen receptor (CAR) was delivered into the T-cells via lentiviral transduction (7CAR8). The T-cells were then expanded in culture from Days 2-8. Following expansion, harvested CAR-T cells (>1B) were then cryopreserved. When thawed, the TALL017 process produced a heterogenous cell population.

Figure 37C:
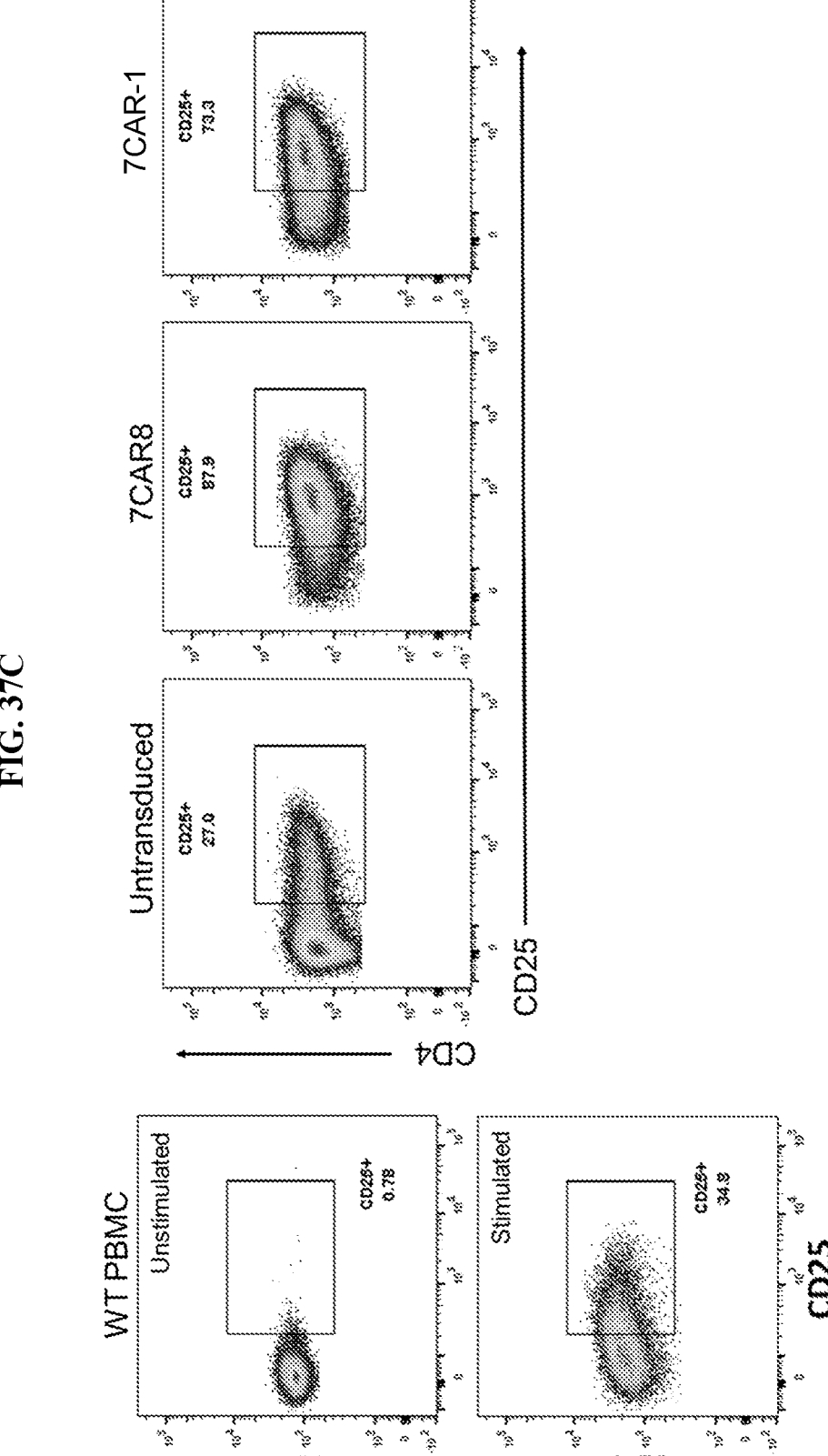

Untransduced (UTD) and transduced TALL017 cells were compared 24 hours post-thaw. CAR activation was verified using flow cytometry by gating cells on CD2+ and CD4+ cells (FIG. 37C). As shown in FIG. 37C, mid-process fratricide induced by anti-CD7 CAR resulted in 7CAR-Ts that were still activated at the time of TALL017 cryopreservation. 7CAR-Ts that were cryopreserved mid-activation thawed poorly.

To produce TALL038 CD7 CAR-T cells as shown in FIG. 37B, frozen apheresis was received from healthy donors. The apheresis was then thawed with Plasmatherm (Barkey GmbH & Co. KG). CD4 and CD8 T-cells were isolated from the thawed apheresis using CliniMACS Prodigy (Miltenyi Biotec). On Day 2, mRNA base editors and guide RNA were delivered into the T-cells by electroporation using Lonza SD Nucleofector. Following base editing, a CD7 chimeric antigen receptor (CAR) was delivered into the T-cells via lentiviral transduction (7CAR8). The T-cells were then expanded in culture from Days 2-10. Following expansion, TCRα/β+ cells were depleted. The T-cells were then further expanded in culture from Days 10-12. The harvested CAR-T cells (>2B) were then cryopreserved on Day 12. When thawed, the TALL038 process produced a homogenous, monodisperse cell population.

Example 23: Evaluation of TALL017 and TALL038 CD7 CAR-T Cells

The editing efficiency in TALL017 and TALL038 CD7 CAR-T cells was compared using next generation sequencing (NGS). As shown in FIG. 38, editing of CD52, CD7, TRAC, and PD-1 in both types of CD7 CAR-T cells ranged from 80-99% efficiency. Untransduced (UTD) cells were used as a control.

Figure 39A:
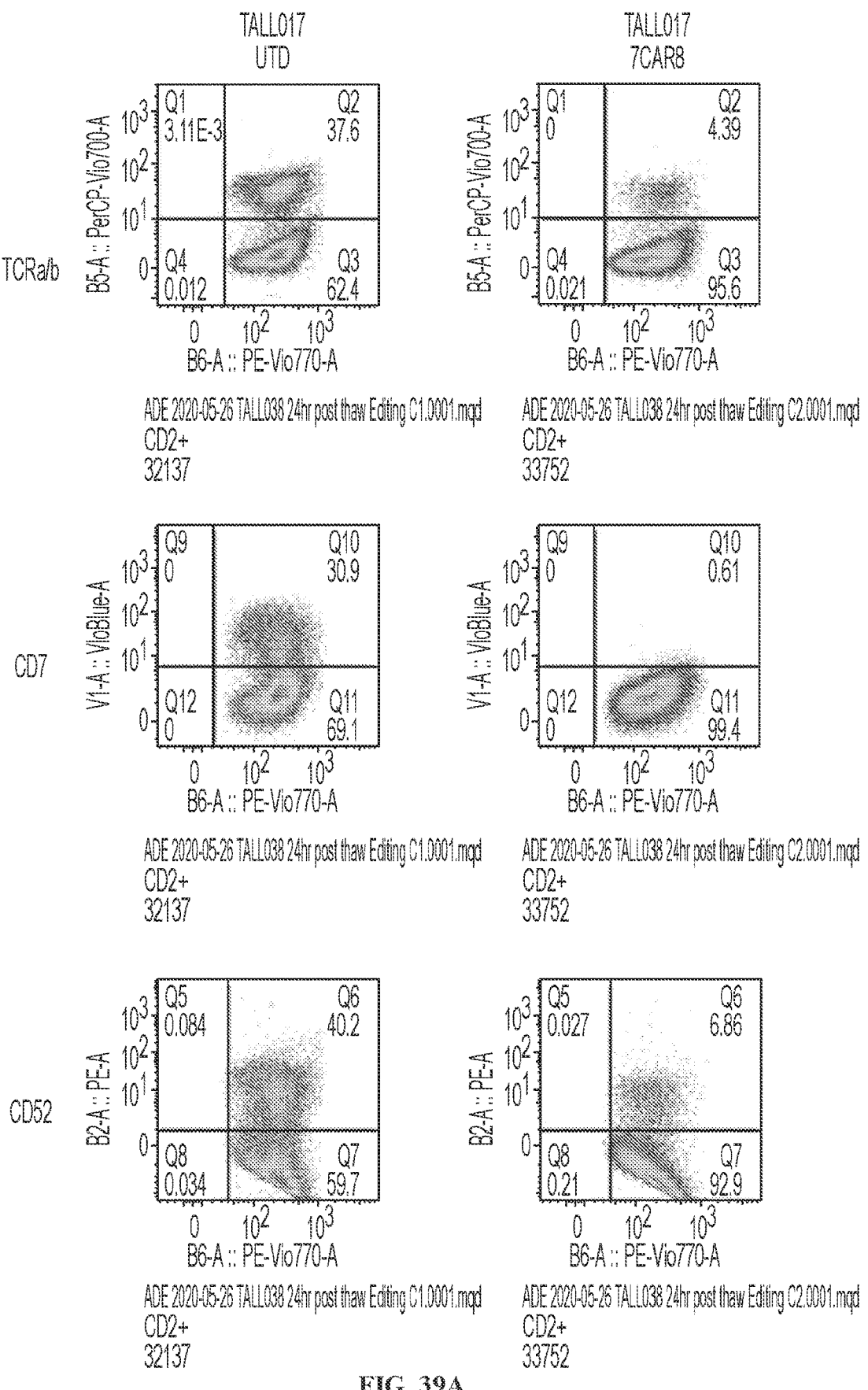
FIGS. 39A-39B depict 24 hr post thaw protein expression of TCRα/β, CD7, and CD52 in TALL017 and TALL038 CD7 CAR-T cells.
Figure 39A:
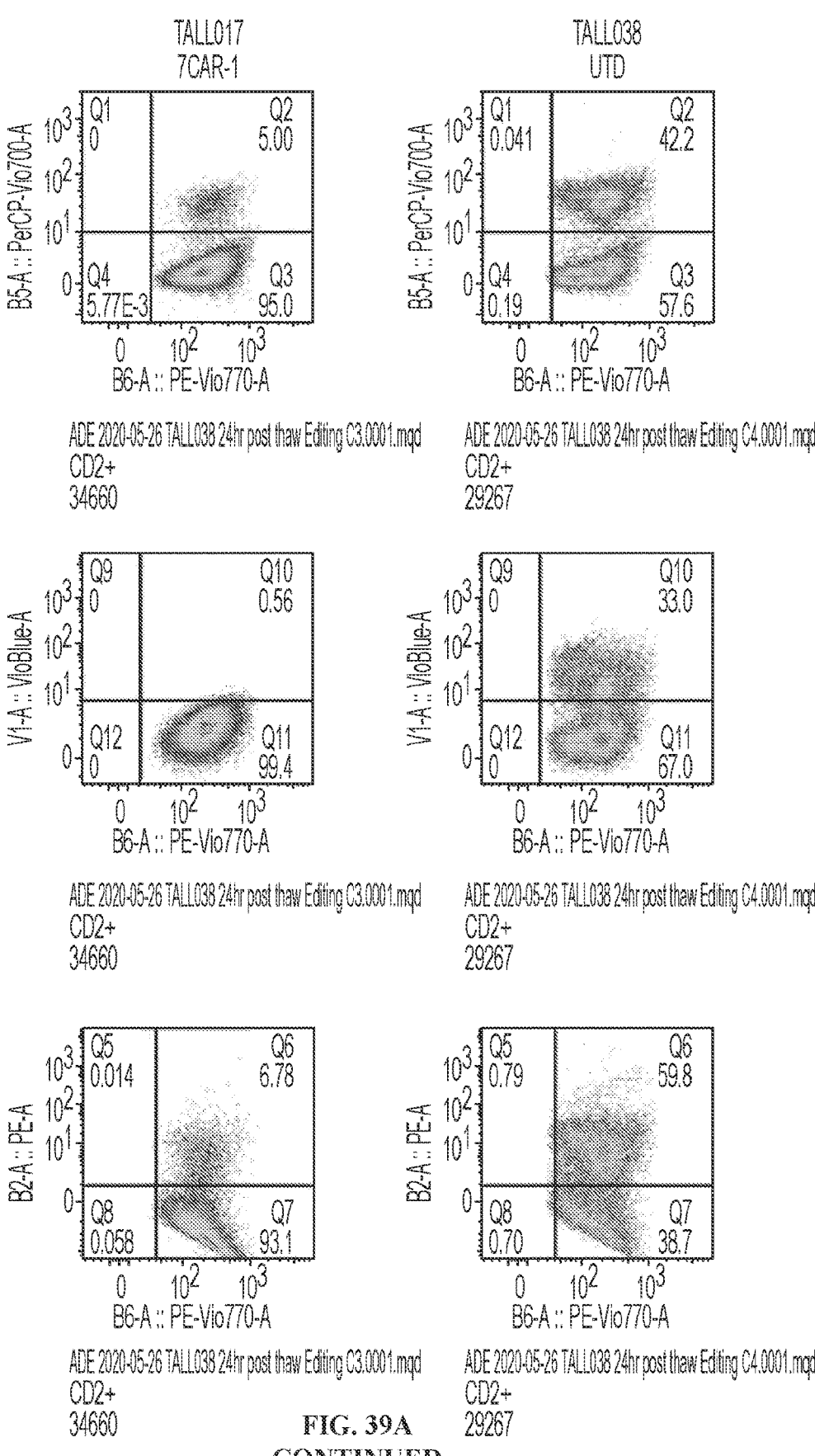
Figure 39B:
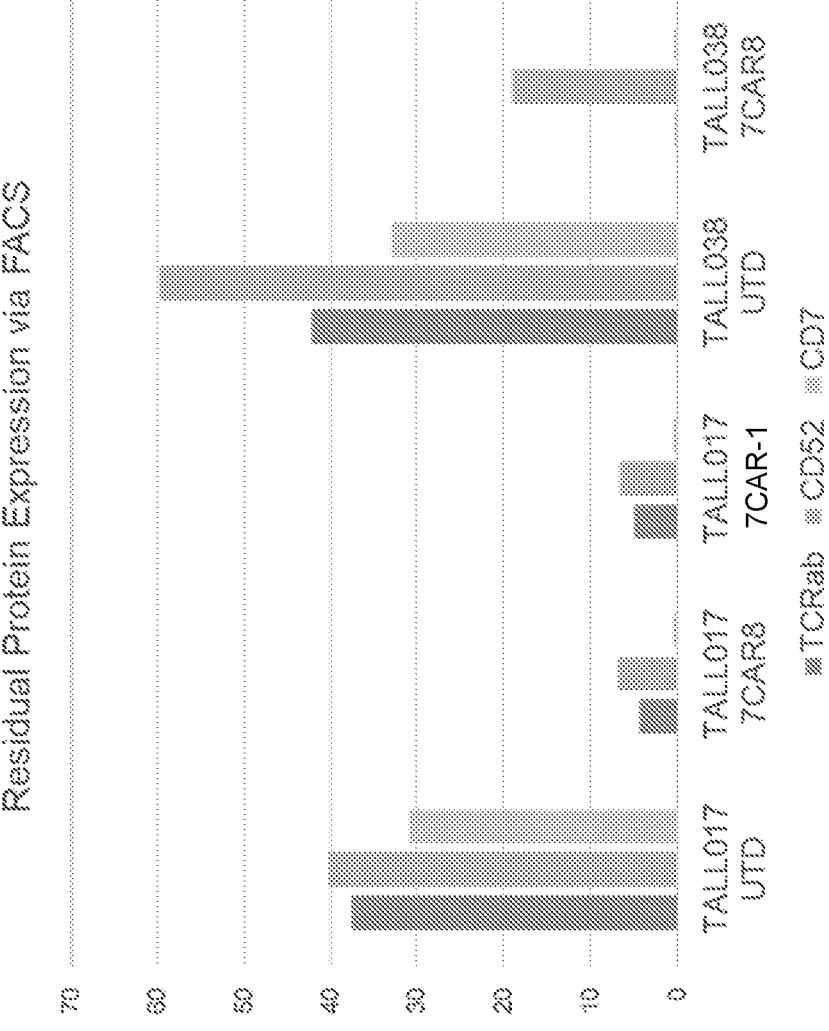

24 hr post thaw protein expression of TCRα/β, CD52 and CD7 was examined in TALL017 and TALL038 CD7 CAR-T cells (FIGS. 39A and 39B). TALL038 cells demonstrated TCRα/β+ cells at <0.4%. Protein expression data matched pre-freeze metrics and post thaw NGS data for both TALL017 and TALL038 CD7 CAR-T cells. Untransduced (UTD) cells were used as a control.

Figure 41:
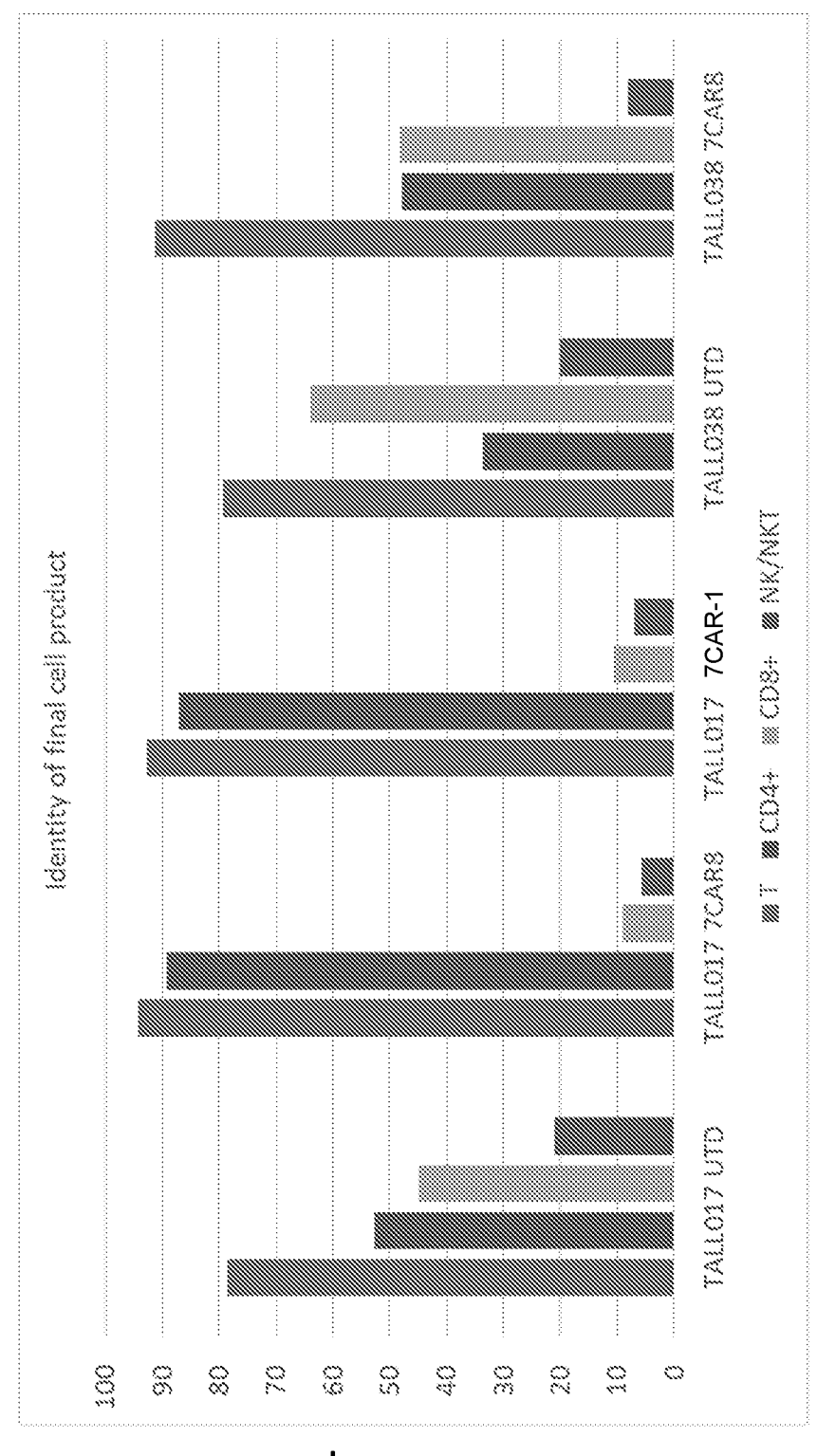
FIG. 41 is a graph depicting the identity of final cell product as a mix of CD2+/− and CD56+/− cells.

In order to evaluate the identity of cells in a population of CD7 CAR-T cells, a gating scheme as shown in FIG. 40 was used. Cells were gated in the following order: FSC/SSC, Singlets, Live/Dead, CD45 (all leukocytes), CD19− (B cell exclusion), CD56−/CD14− (NK/monocyte exclusion), CD2+ (T cells), and CD4:CD8 of CD2+. As shown in FIG. 41, the identity of TALL017 and TALL038 CD7 CAR-T cell populations were a mix of CD2+/− and CD56+/− cells. There were no detectable mono or B cells.

Figure 42:
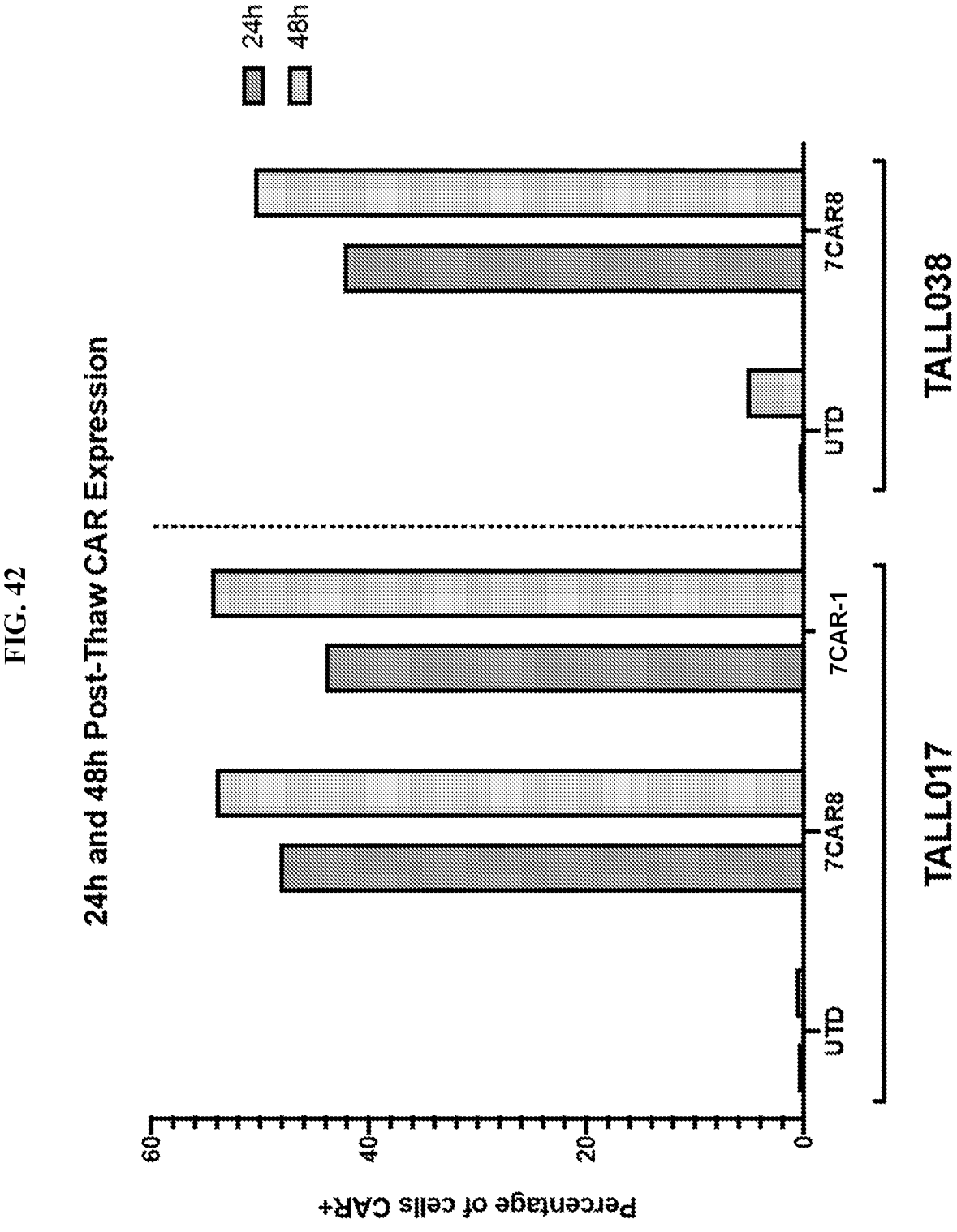
FIG. 42 is a graph depicting 24 h and 48h post-thaw CD7 CAR-T cell expression.

Finally, CAR expression was evaluated. As shown in FIG. 42, both TALL017 and TALL038 CD7 CAR-T cell populations maintained CAR+ cell expression up to 48h post-thaw. Untransduced (UTD) cells were used as a control.

Figure 43:
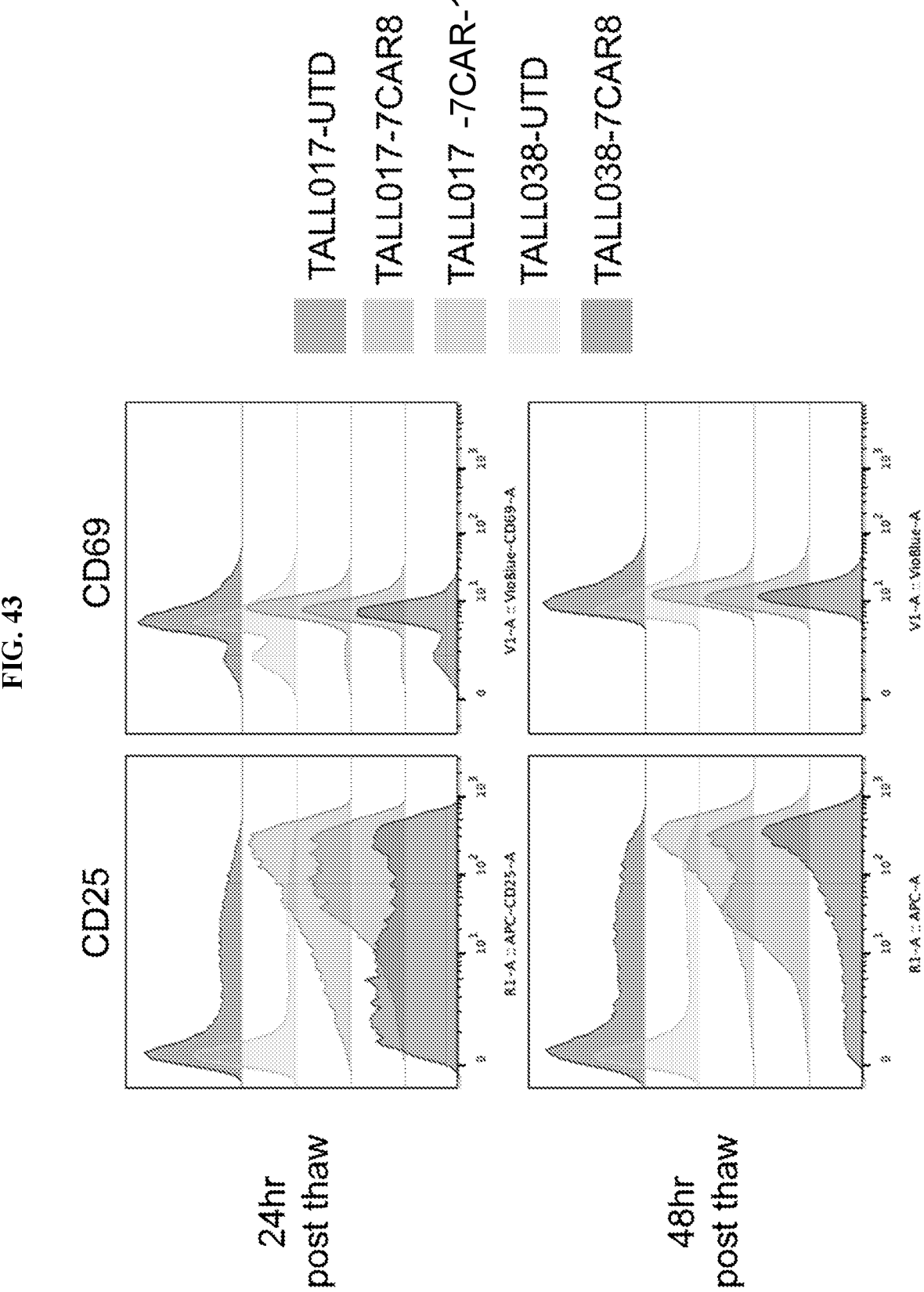
FIG. 43 includes graphs depicting that CD25 expression post thaw is lower in TALL038 CD7 CAR-T cells compared to TALL017 CD7 CAR-T cells.

CD25 and CD69 expression was also evaluated 24 h and 48 post thaw in TALL017 and TALL038 CD7 CAR-T cells. As shown in FIG. 43, CD25 expression post thaw was lower in TALL038 cells compared to TALL017 cells. CD25 is a marker of mid-stage T cell activation. Unlike most CARs, anti-CD7 CAR induces mid-culture fratricide that further activates 7CARTs. Freezing TALL017 cells in an activated state was detrimental to cell health. TALL038 cells have dramatically lower CD25 expression compared to TALL017, which may suggest a higher resistance to freezing.

Example 24: In Vitro Characterization of TALL038 CD7 CAR-T Cells

In order to characterize TALL038 CD7 CAR-T cells in vitro, a bead based potency method was developed (FIG. 44). On Day 0, CD7 was coupled with Dynabeads and CD7 CAR-T cells and untranduced (UTD) cells were thawed. On Day 1, CD7 beads were purified and CD7 CAR-T cells were

Example 25: In Vivo Characterization of TALL038 CD7 CAR-T Cells

Previous studies have shown that CCRF models showed a response to CD7-directed CAR-T therapy (see e.g., Gomes-Silva D., et al., CD7-edited T cells expressing a CD7-specific CAR for the therapy of T-cell malignancies. Blood. 2017; 130:285-296).

In order to characterize TALL038 CD7 CAR-T cells in vivo, a study was developed to assess the efficacy of TALL038 drug product on in vivo growth in a CCRF model of T-ALL. Table 25 summarizes the study protocol.

TABLE 25

| | | CCRF Model In Vivo Study | | | | | |
|---|---|---|---|---|---|---|---|
| Group | Tumor | CCRF-GFP+ Cells Per Mouse | N Mice Per Group | Treatment | (T Cell) Cells Per Mouse* | Route | Tissue Collection |
| 1 | CCRF GFP+ | 1e5 | 10 | DPBS | none | IV | Blood |
| 2 | CCRF GFP+ | 1e5 | 10 | UTD CAR | 1.00E+07 | IV | Blood |
| 3 | CCRF GFP+ | 1e5 | 10 | 7CAR8 | 1.00E+07 | IV | Blood |
| 4 | CCRF GFP+ | 1e5 | 10 | 7CAR8 | 3.00E+06 | IV | Blood |
| 5 | CCRF GFP+ | 1e5 | 10 | 7CAR8 | 1.00E+06 | IV | Blood |
| 6 | CCRF GFP+ | 1e5 | 10 | Excluded as outliers during randomization | | | | co-cultured, plated, and incubated at 37° C. On Day 2, the supernatant was collected and a readout was obtained using an enzyme-linked lectin assay (ELLA).

Figure 45B:
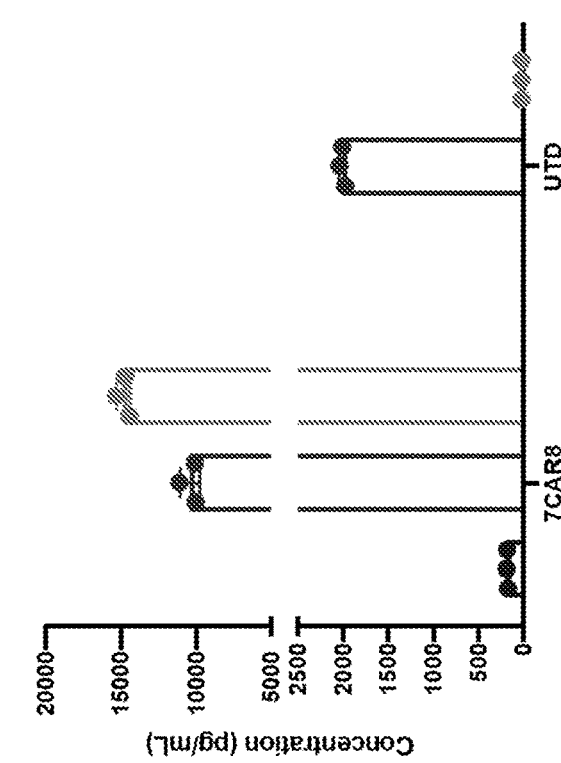
FIGS. 45A-45B depict that TALL038 CD7 CAR-T cells release IFNγ, TNFα, and IL-2 compared in response to CD7 antigen.
Figure 45A:
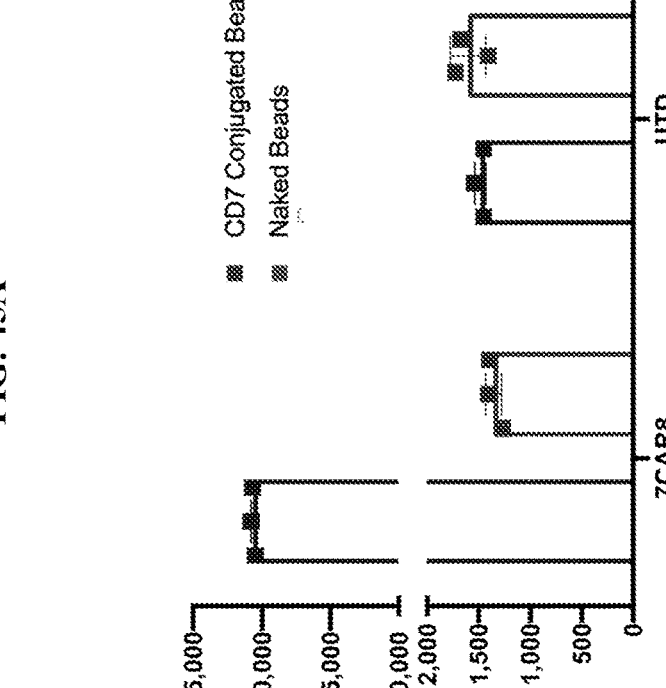

Using this assay, TALL038 CD7 CAR-T cells were evaluated for IFNγ, TNFα, IL-10, and IL-2 release. In response to CD7 antigen, TALL038 CD7 CAR-T cells released IFNγ, TNFα, and IL-2 (FIGS. 45A and 45B). Untransduced (UTD) cells were used as a control.

Figure 46:
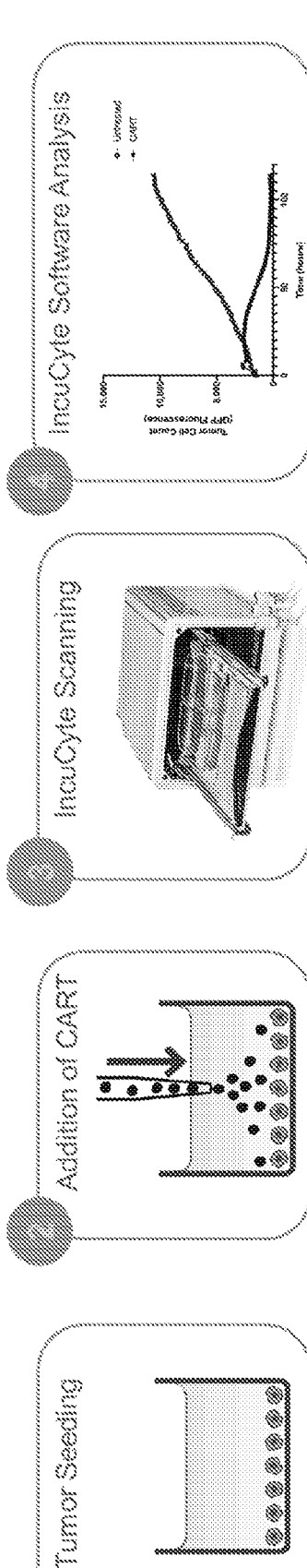
FIG. 46 is a schematic depicting a co-culture protocol for measurement of CAR directed T-cell killing of tumor cells.

In order to further characterize TALL038 CD7 CAR-T cells in vitro, a co-culture method was developed to measure CAR directed T-cell killing of target tumor cells. FIG. 46 provides an overview of the assay. First, tumor cells are seeded. CAR-T cells are then added to the seeded tumor cells. The cells are then analyzed using IncuCyte® Scanning System. Finally, a reading is obtained using IncuCyte® Software.

TALL038 CD7 CAR-T cells were added to seeded CCRF-CEM GFP+ tumor cells. The T-Cell lots in Table 24 were tested in E:T ratios of 4:1 CAR:CCRF, 2:1 CAR:CCRF, or 1:1 CAR:CCRF:

TABLE 24

| T-Cell Lots | |
|---|---|
| Lot | % CAR+ |
| TALL017 UTD | 0% CAR+ |
| TALL017 7CAR8 | ~50% CAR+ |
| TALL038 UTD | 0% CAR+ |
| TALL038 7CAR8 | ~50% CAR+ |

Figures 47A, 47B:
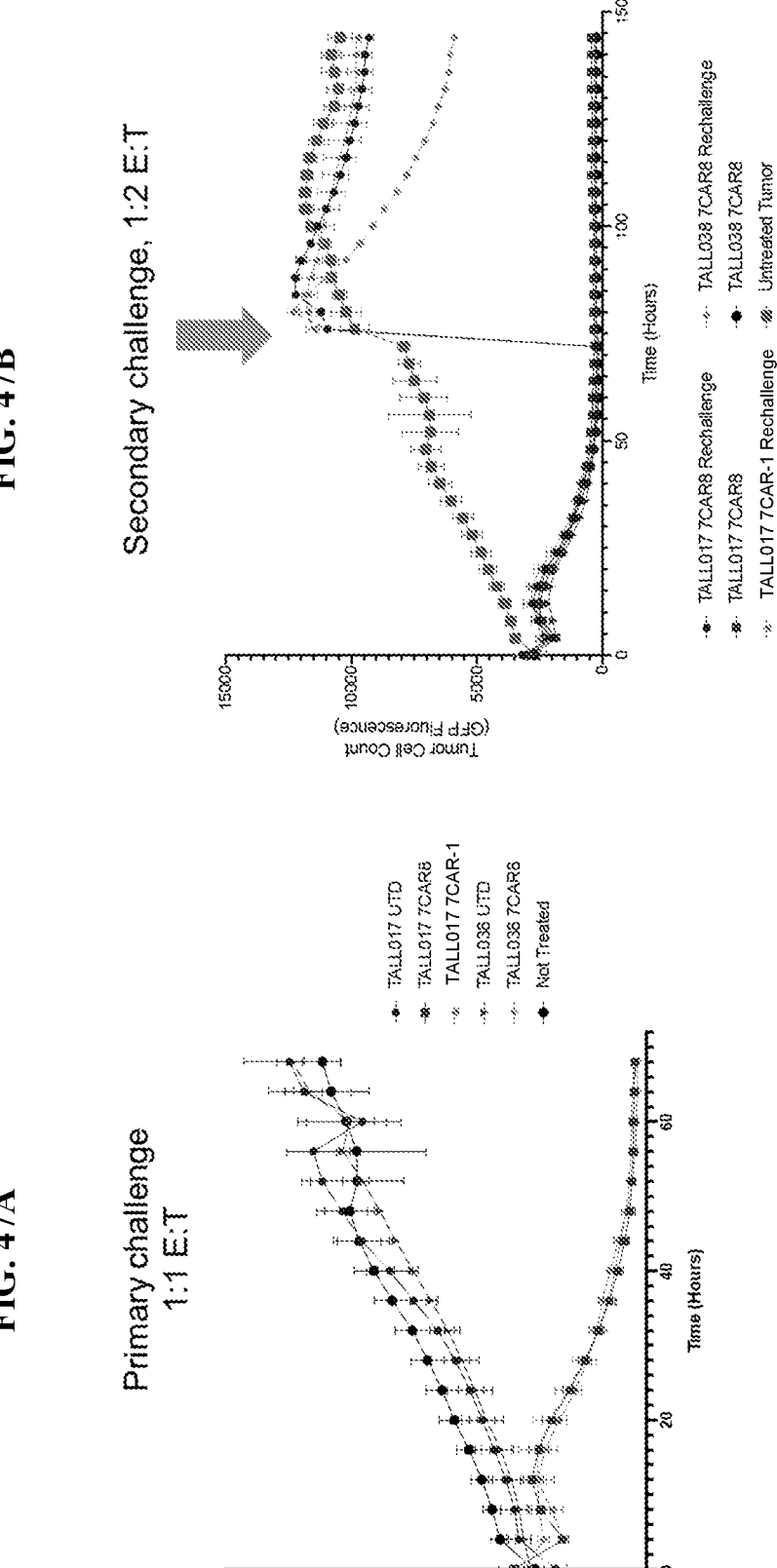
FIGS. 47A-47B depict that TALL038 CD7 CAR-T cells exhibit increased CCRF when re-challenged compared to TALL017 CAR T cells.

As shown in FIGS. 47A and 47B, TALL038 CD7 CAR-T cells exhibited increased CCRF when re-challenged compared to TALL017 CAR T cells.

Ten 6-7 week old female NSG mice (Jackson Labs: Stock 005557) were implanted with CCRF-GFP+ cells (1e5) intravenously (IV). On day 11, the mice were transplanted with 250 μL total TALL038 1e7cells/mouse via IV. IVIS imaging measurements were taken 3x/week post injection for 2-3 weeks to monitor tumor burden. Whole blood was collected 1x/week for 2-3 weeks. 3x/week Bodyweights and Clinical Observations post implant were made.

Figure 48:
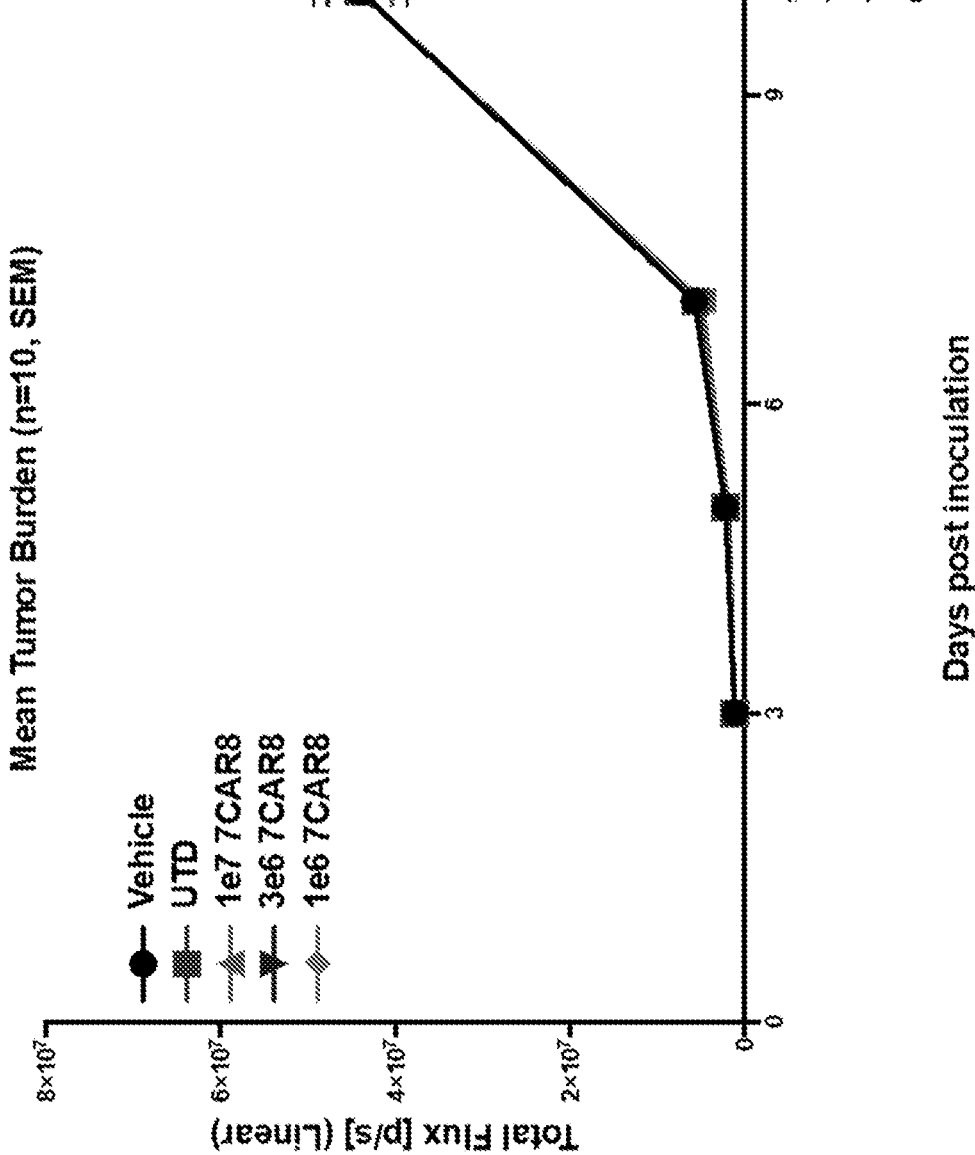
FIG. 48 is a graph depicting Bioluminescent Radiance Data at Day 10 Post CCRF Implant/Day −1 to CD7 CAR-T Treatment (mean, SEM). Total flux is measured on a linear scale.
Figure 49B:
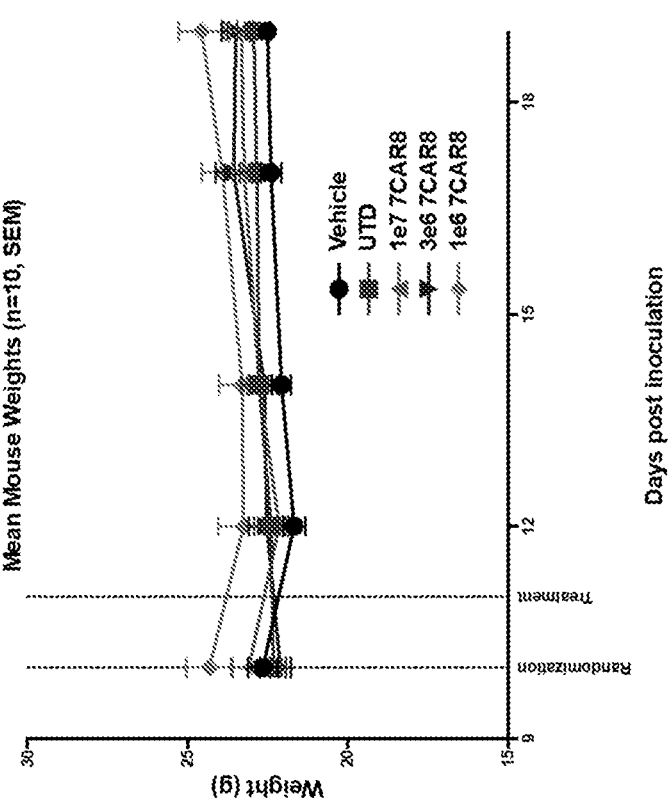
FIGS. 49A-49B depict Bioluminescent Radiance Data at Day 19 Post CCRF Implant/Day 8 Post CD7 CAR-T Treatment (mean, SEM).
Figure 49A:
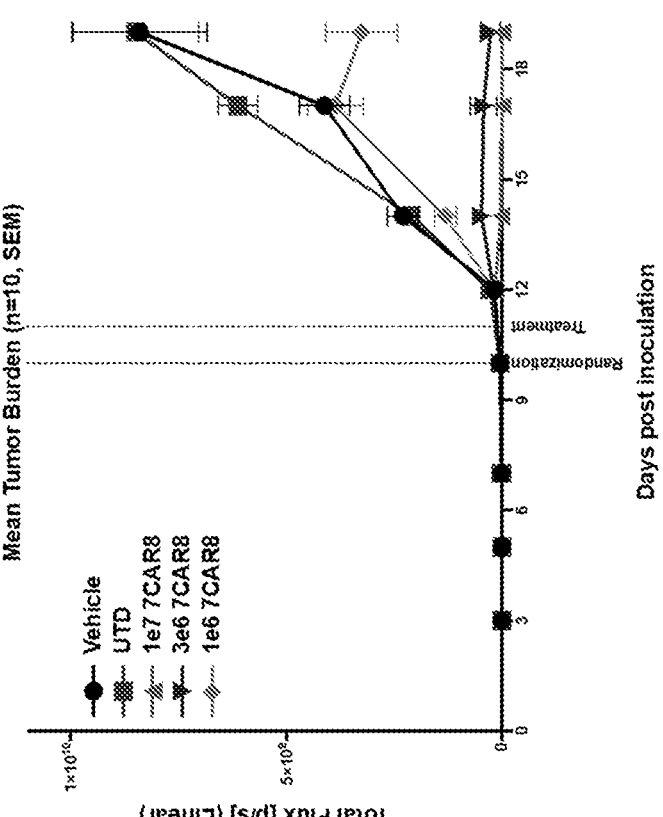
Figure 50B:
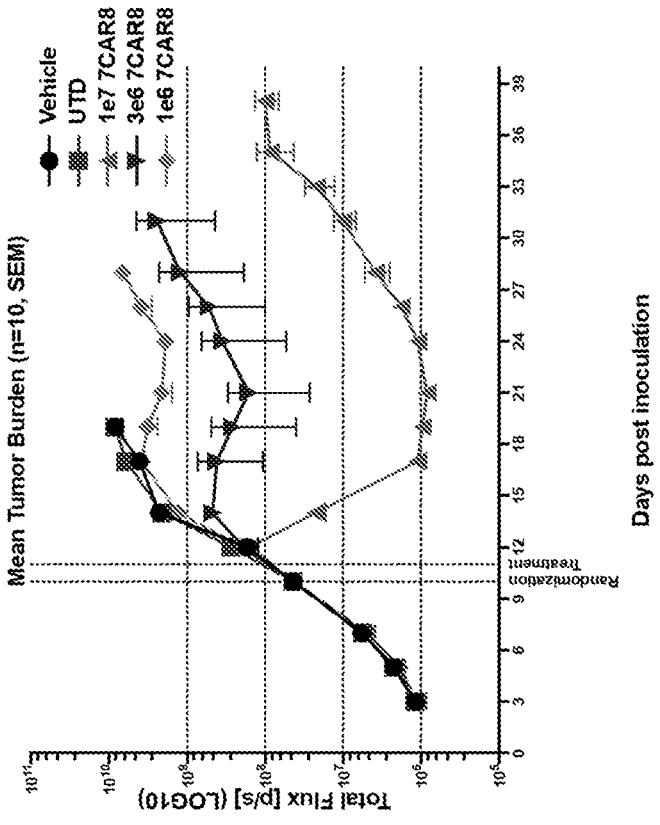
FIGS. 50A-50B depict Bioluminescent Radiance Data at Day 38 Post CCRF Implant/Day 27 Post CD7 CAR-T Treatment (mean, SEM).
Figure 50A:
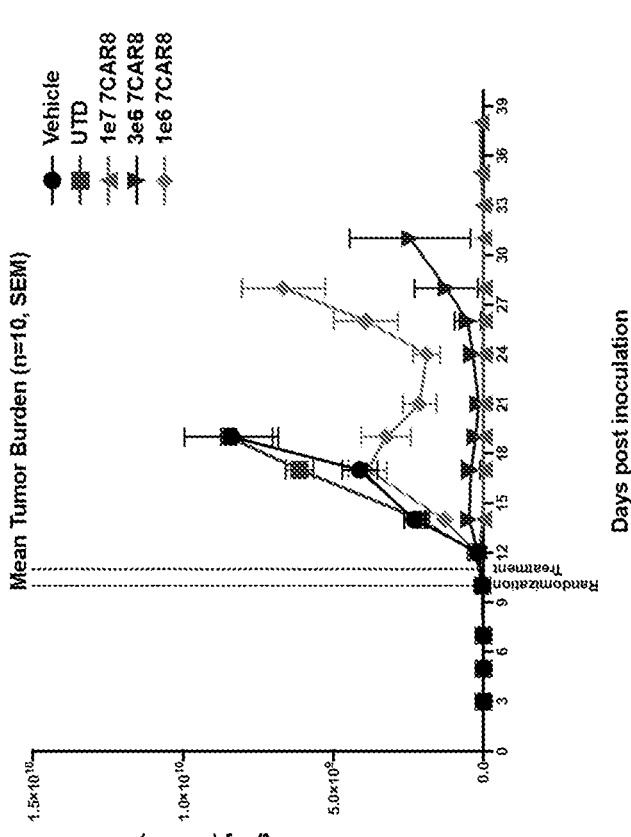
Figures 51A, 51B:
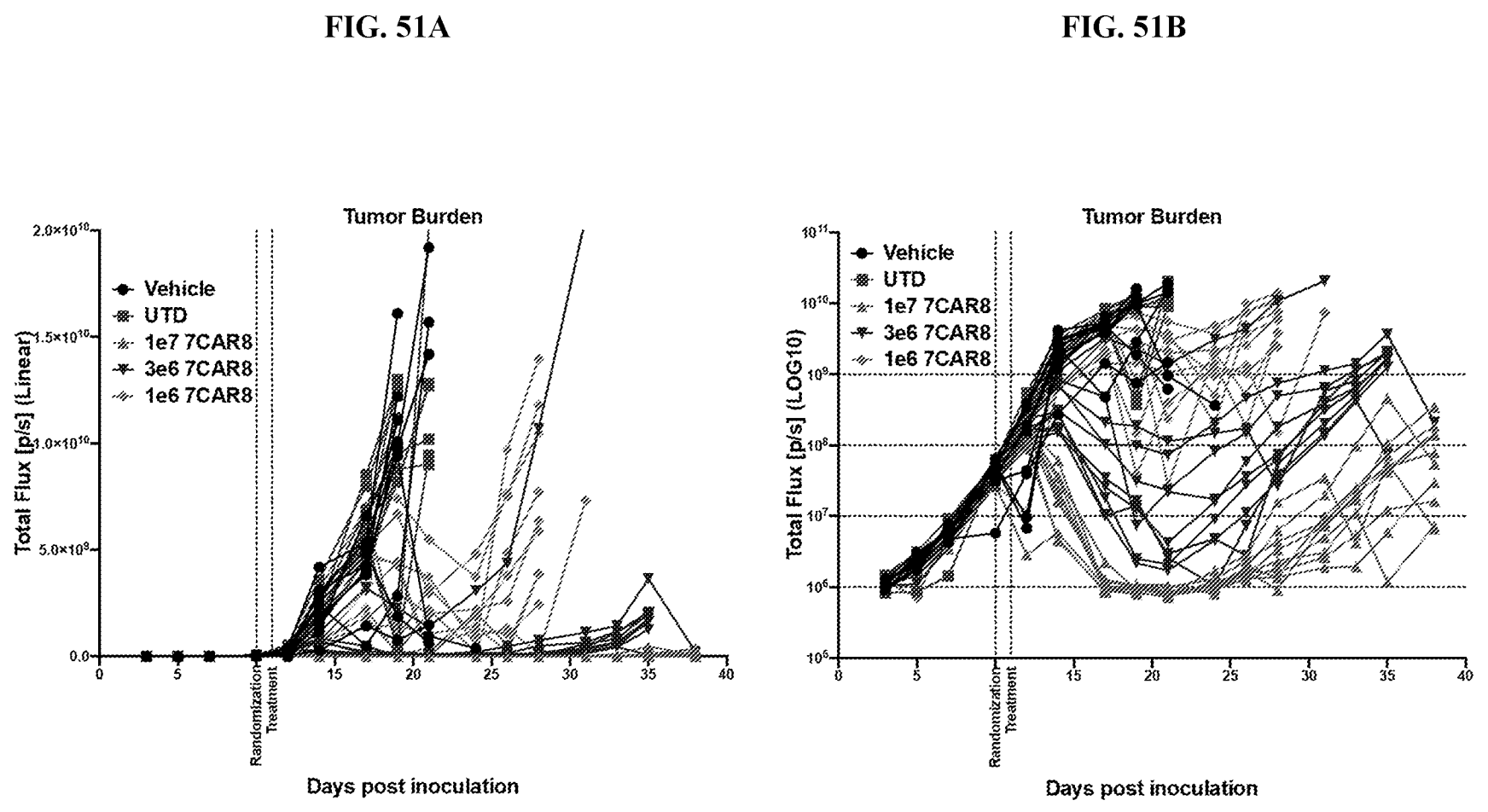
Figure 52A:
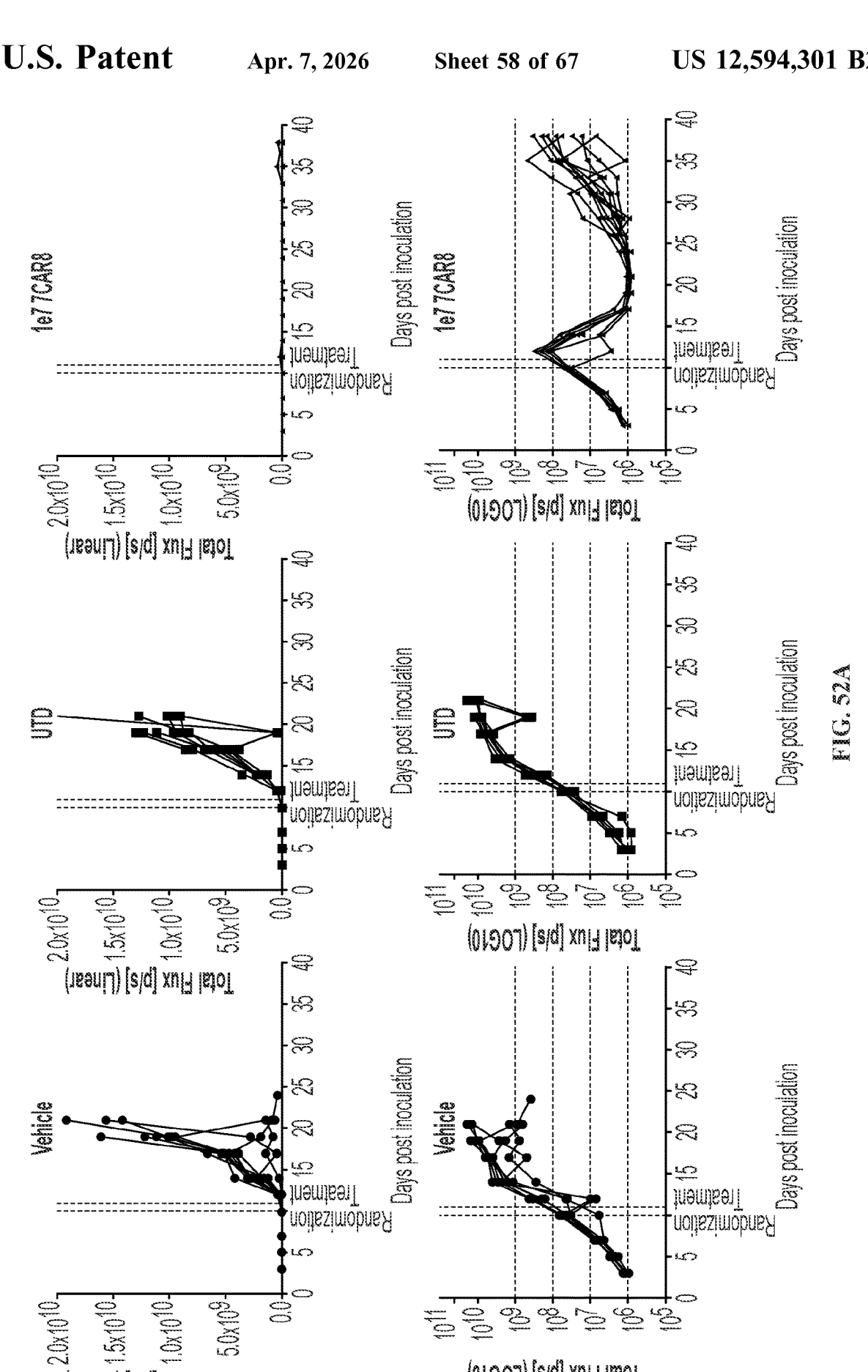
FIGS. 52A-52B depict Bioluminescent Radiance Data at Day 38 Post CCRF Implant/Day 27 Post CD7 CAR-T Treatment (individual mice).
Figure 52B:
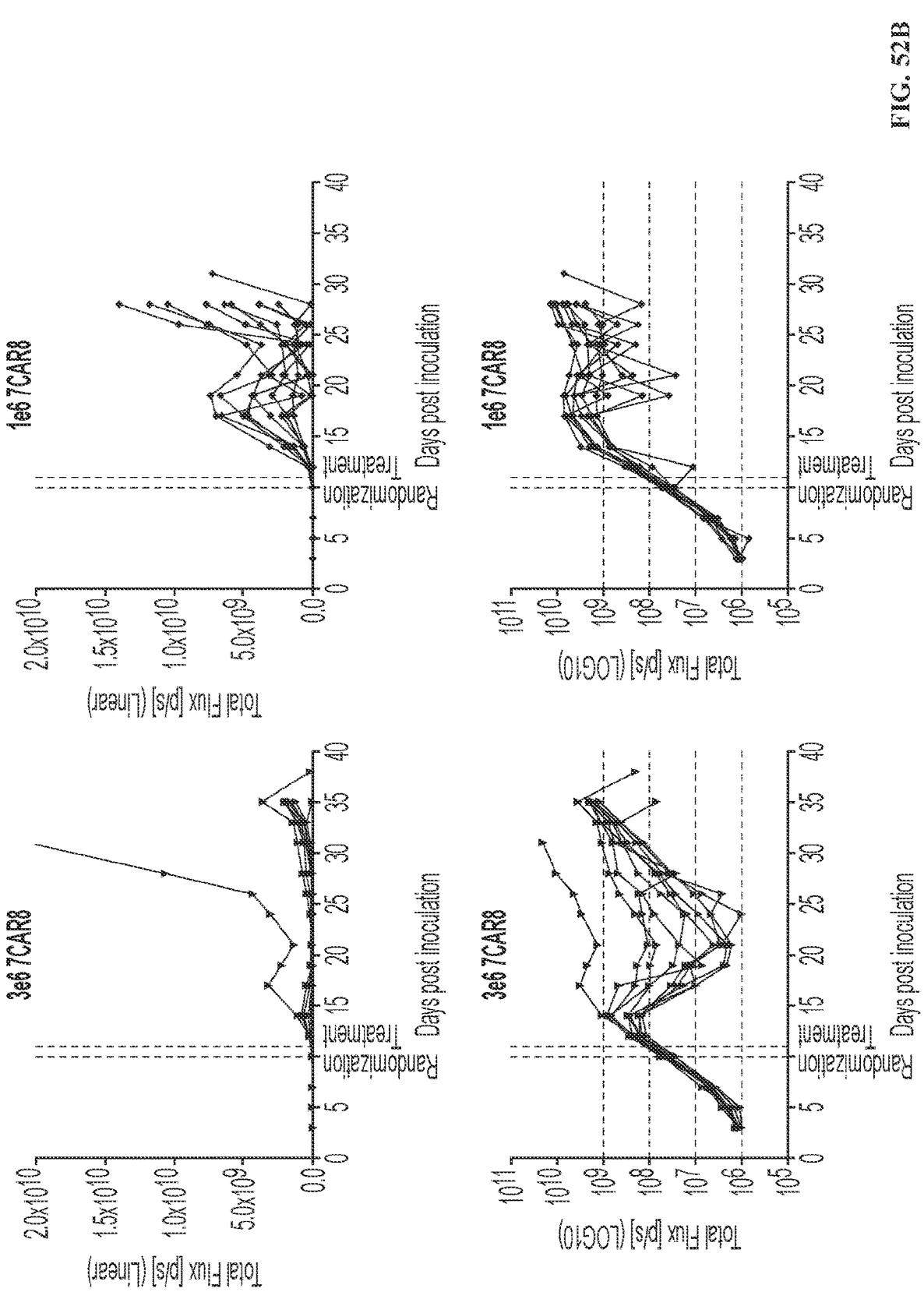

FIG. 48 shows Bioluminescent Radiance Data at Day 10 Post CCRF Implant/Day –1 to CD7 CAR-T treatment (mean, SEM). At this timepoint, mice did not present with a measurable tumor burden needed for CD7 CAR-T treatment. FIGS. 49A and 49B show Bioluminescent Radiance Data at Day 19 Post CCRF Implant/Day 8 Post 7CAR8 Treatment (mean, SEM). At this timepoint, dose-dependent tumor growth inhibition was observed in response to CD7 CAR– T treatment. Mice did not lose weight in response to CD7 CAR-T treatment. FIGS. 50A and 50B show Bioluminescent Radiance Data at Day 38 Post CCRF Implant/Day 27 Post CD7 CAR-T treatment (mean, SEM). Following the date at which the first mouse in each group reached a humane endpoint (Flux>1e10), mean and standard error were no longer plotted. At this timepoint, sustained, dose-dependent inhibition was observed in each group prior to relapse. By using a logarithmic scale in FIG. 50B, the relapse in 1e7 of the CD7 CAR-T group was visualized. The Bioluminescent Radiance Data at Day 38 Post CCRF Implant/Day 27 Post CD7 CAR-T treatment are shown for individual mice in FIGS. 51A, 51B, 52A, and 52B. For the above experiments, UTD and vehicle were used as controls.

Example 26: CD5-Targeting CAR-Ts for T-ALL Treatment and Lymphoma Monotherapy Previous studies have recognized the need for creating improved CAR-T products by targeting multiple cancer antigens (see e.g., Xinjie Xu, et al., Mechanisms of Relapse After CD19 CAR T-Cell Therapy for Acute Lymphoblastic Leukemia and Its Prevention and Treatment Strategies. *Front Immunol.* 2019; 10: 2664, Nov. 12, 2019; E. Mejstrik-ová, et al., CD19-negative relapse of pediatric B-cell precursor acute lymphoblastic leukemia following blinatumo-mab treatment. *Blood Cancer Journal,* 7: 659 (2017); Hanren Dai, et al., Bispecific CAR-T cells targeting both CD19 and CD22 for therapy of adults with relapsed or refractory B cell acute lymphoblastic leukemia. *J. Hematology & Oncology.* 13:30 (2020); Robbie G. Majzner and Crystal L. Mackall, Tumor Antigen Escape from CAR T-cell Therapy. Cancer Discov. 2018 October; 8(10):1219-1226;

CD5 expression has been identified in T- and NK-cell malignancies, including but not limited to T-ALL, MF/SS, primary cutaneous T-cell lymphoma (NOS), T-cell large granular lymphocytic leukemia, angioimmunoblastic T/NK-cell lymphoma, Hepatosplenic T-cell lymphoma, primary cutaneous CD30+LPD, adult T-cell leukemia/lymphoma, and T-cell prolymphocytic leukemia. Combining CD5 with CD7 would unlock a greater potential for liquid cancer therapy for certain cancers, such as T-ALL, MF/SS, primary cutaneous T-cell lymphoma (NOS), angioimmunoblastic T/NK-cell lymphoma, and adult T-cell leukemia/lymphoma.

To reduce or eliminate expression of CD5 in T cells, 42 cytidine base editor single guide RNAs (sgRNAs) were generated (Agilent) as provided in Table 26 below.

TABLE 26

CDS Guide RNAs

| Guide Name | Guide Grouping | Guide Sequence | SEQ ID NO: |
|---|---|---|---|
| RCM sgRNA 102 | Ex1 SD (Pos 6) | ACUCACCCAGCAUCCCCAGC | 1458 |
| RCM sgRNA 103 | Ex2SA (Pos6) | AGCGACUGCAGAAAGAAGAG | 1 |
| RCM sgRNA 104 | Ex2 STOP (pos 5/6) | CAUACCAGCUGAGCCGUCCG | 2 |
| RCM sgRNA 105 | Ex3 SA (Pos 8) | UGGAAAUCUGGGGGUCAGAA | 1459 |
| RCM sgRNA 106 | Ex3 SD (Pos 9) | GUUACCCACCUAAGCAGGUC | 1460 |
| RCM sgRNA 107 | Ex3 STOP (pos 5) | CUGCCAGCGGCUGAACUGUG | 1461 |
| RCM sgRNA 108 | Ex3 STOP (Pos 5/6) | CCUCCCACUGCUuGGAGCUC | 1462 |
| RCM sgRNA 109 | Ex3 STOP (pos 6) | UCUGCCAGCGGCUGAACUGU | 1463 |
| RCM sgRNA 110 | Ex3 STOP (pos 7) | GUCUGCCAGCGGCUGAACUG | 1464 |
| RCM sgRNA 111 | Ex3 STOP (Pos 8) | GAAGUGCCAGGGCCAGCUGG | 1465 |
| RCM sgRNA 112 | Ex3 STOP (Pos 8/9) | CCAUGUGCCAUCCGUCCUUG | 1466 |
| RCM sgRNA 113 | Ex3 STOP (Pos 9) | UUUGCAGCCAGAGCUGGGGC | 1467 |
| RCM sgRNA 114 | Ex4 SA (Pos 5) | GGUUCUGCAAUGAGACACUC | 1468 |

TABLE 26-continued

CDS Guide RNAs

| Guide Name | Guide Grouping | Guide Sequence | SEQ ID NO: |
|---|---|---|---|
| RCM sgRNA 115 | Ex5 SA (Pos 5) | GAGCUAGGAGAGGAGAGAGC | 1469 |
| RCM sgRNA 116 | Ex5 SD (Pos 8) | UCACUUACCUGAGCAAAGGA | 1470 |
| RCM sgRNA 117 | Ex5 SD (Pos 9) | CUCACUUACCUGAGCAAAGG | 1471 |
| RCM sgRNA 118 | Ex5 STOP (Pos 4) | CUGCAGCUGGUGGCACAGUC | 1472 |
| RCM sgRNA 119 | Ex5 STOP (Pos 5) | CGGCCAGCACUGUGCCGGCG | 1473 |
| RCM sgRNA 120 | Ex5 STOP (Pos 6/7) | AUCUUCCAUUGGAUUGGCAA | 1474 |
| RCM sgRNA 121 | Ex5 STOP (Pos 7/8) | GAUCUUCCAUUGGAUUGGCA | 1475 |
| RCM sgRNA 122 | Ex6 SA (Pos 4) | AACCUGAGAGGGGAAGCAAU | 1476 |
| RCM sgRNA 123 | Ex6 SA (Pos 5) | AAACCUGAGAGGGGAAGCAA | 1477 |
| RCM sgRNA 124 | Ex6 STOP (Pos 4) | GUGCAGAGCCGUCUGGUGGG | 1478 |
| RCM sgRNA 125 | Ex6 STOP (Pos 4/5) | CUCCCACCGCAGCGAGCUCC | 1479 |
| RCM sgRNA 126 | Ex6 STOP (Pos 4/5) | CUCCCAAAGUUCGUGGCACU | 1480 |
| RCM sgRNA 127 | Ex6 STOP (Pos 5) | AGGUGCAGAGCCGUCUGGUG | 1481 |
| RCM sgRNA 128 | Ex6 STOP (Pos 5) | GGUGCAGAGCCGuCUGGUGG | 1482 |
| RCM sgRNA 129 | Ex6 STOP (Pos 5/6) | UCUCCCAAAGUUCGUGGCAC | 1483 |
| RCM sgRNA 130 | Ex6 STOP (Pos 6) | UGUCCCAGUGCCACGAACUU | 1484 |
| RCM sgRNA 131 | Ex6 STOP (Pos 7) | AAGGUGCAGAGCCGUCUGGU | 1485 |
| RCM sgRNA 132 | Ex6 STOP (Pos 7) | UCCUAUCGAGUGCUGGACGC | 1486 |
| RCM sgRNA 133 | Ex6 STOP (Pos 8) | CAAGGUGCAGAGCCGUCUGG | 1487 |
| RCM sgRNA 134 | Ex6 STOP (Pos 8) | GGUGCGCCAGGGGGCUCAGU | 1488 |
| RCM sgRNA 135 | Ex6 STOP (Pos 8/9) | GGGCUGCCCACUGAGCCCCC | 1489 |
| RCM sgRNA 136 | Ex6 STOP (Pos 9) | AGGUGCGCCAGGGGGCUCAG | 1490 |
| RCM sgRNA 137 | Ex7 STOP (Pos 4) | GGCCAGGAUCCAAACCCCGC | 1491 |
| RCM sgRNA 138 | Ex8 STOP (Pos 4) | CGCCAGUGGAUUGGCCCAAC | 1492 |
| RCM sgRNA 139 | Ex8 STOP (Pos 7) | AAGAAGCAGCGCCAGUGGAU | 1493 |

587

TABLE 26-continued

| CDS Guide RNAs | | | |
|---|---|---|---|
| Guide Name | Guide Grouping | Guide Sequence | SEQ ID NO: |
| RCM sgRNA 140 | Ex9 SA (Pos 8) | AAAGACACUGGGCAGAUGGU | 1494 |
| RCM sgRNA 141 | Ex9 SD (Pos 6) | GCUUACCUGGAUAAGCUGAC | 1495 |
| RCM sgRNA 142 | Ex10 SA (Pos 9) | UUCCAGAGCUGGGGAAAGAA | 1496 |
| RCM sgRNA 143 | Ex10 STOP (Pos 9) | AUGGGGCUCAGAGGCUGUAA | 1371 |

Figure 53:
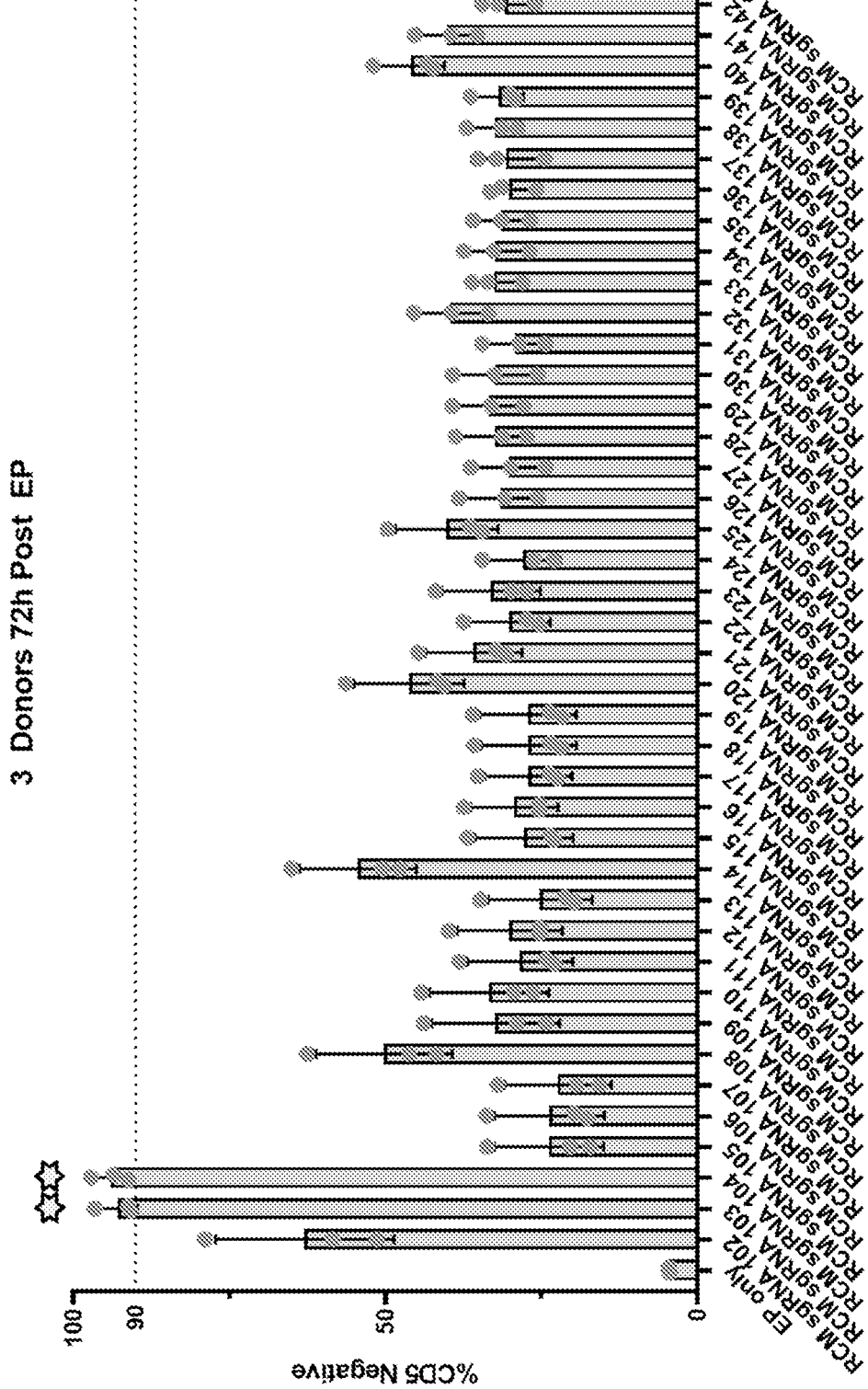
FIG. 53 is a graph depicting editing efficiency of CD5 gRNA candidates.

CD5 editing was verified by screening the guides against a minimum of n=3 donors and a minimum of n=5 antibody clones 72 h post electroporation using flow cytometry, next generation sequencing (NGS), RNA, and Western blot analysis (FIG. 53). Electroporation only (EP) was used as a negative control. Use of cytidine base editors with the CD5 guide RNAs efficiently reduced or eliminated CD5 expression in T cells.

Two candidate guides, sgRNA 103 (splice disruption) and sgRNA 104 (STOP codon), were selected for further tested for base editing efficiency via NGS when used in combination with BE4. Both sgRNA 103 and sgRNA 104 demonstrated about 85% editing efficiency. Table 27 below provides the result from an in silico OT analysis performed using sgRNA 103 and sgRNA 104.

TABLE 27

In silico OT Analysis

| | | | bulge_type | | | | | | | | | |
|---|---|---|---|---|---|---|---|---|---|---|---|---|
| | | | None | None | None | None | None | None | DNA | DNA | RNA | RNA |
| | | | | | | | bulge_length | | | | | |
| | | | 0 | 0 | 0 | 0 | 0 | 0 | 1 | 1 | 1 | 1 |
| | | | | | | | | num_mm | | | | |
| target_site_name | pam | ot_category | 0 | 2 | 3 | 4 | 5 | 6 | 1 | 2 | 1 | 2 |
| sgRCM103 | NAA | Exon | 0 | 1 | 5 | 46 | 323 | 1902 | 0 | 3 | 0 | 2 |
| sgRCM103 | NAA | None | 0 | 3 | 52 | 647 | 5918 | 40065 | 0 | 8 | 0 | 80 |
| sgRCM103 | NAA | TS exon | 0 | 0 | 0 | 3 | 27 | 94 | 0 | 0 | 0 | 0 |
| sgRCM103 | NAG | Exon | 0 | 2 | 4 | 41 | 340 | 1883 | 0 | 0 | 0 | 2 |
| sgRCM103 | NAG | None | 0 | 2 | 34 | 444 | 3633 | 24615 | 0 | 5 | 1 | 37 |
| sgRCM103 | NAG | TS exon | 0 | 0 | 1 | 2 | 19 | 104 | 0 | 0 | 0 | 2 |
| sgRCM103 | NGA | Exon | 0 | 0 | 0 | 25 | 200 | 1214 | 0 | 2 | 0 | 4 |
| sgRCM103 | NGA | None | 0 | 0 | 23 | 381 | 3357 | 22500 | 2 | 5 | 0 | 29 |
| sgRCM103 | NGA | TS exon | 0 | 0 | 0 | 0 | 18 | 60 | 0 | 1 | 0 | 0 |
| sgRCM103 | NGG | Exon | 1 | 1 | 2 | 29 | 202 | 1202 | 0 | 1 | 0 | 2 |
| sgRCM103 | NGG | None | 0 | 0 | 29 | 294 | 2710 | 18612 | 1 | 4 | 0 | 28 |
| sgRCM103 | NGG | TS exon | 0 | 0 | 0 | 0 | 10 | 65 | 0 | 0 | 0 | 0 |
| sgRCM104 | NAA | Exon | 0 | 0 | 0 | 4 | 26 | 256 | 0 | 0 | 0 | 1 |
| sgRCM104 | NAA | None | 0 | 0 | 2 | 26 | 386 | 3483 | 0 | 0 | 0 | 3 |
| sgRCM104 | NAA | TS exon | 0 | 0 | 0 | 0 | 1 | 7 | 0 | 0 | 0 | 0 |
| sgRCM104 | NAG | Exon | 0 | 0 | 0 | 5 | 44 | 502 | 0 | 0 | 0 | 0 |
| sgRCM104 | NAG | None | 0 | 0 | 2 | 36 | 461 | 5459 | 0 | 0 | 0 | 4 |
| sgRCM104 | NAG | TS exon | 0 | 0 | 0 | 0 | 0 | 27 | 0 | 0 | 0 | 0 |
| sgRCM104 | NGA | Exon | 0 | 0 | 0 | 2 | 38 | 364 | 0 | 0 | 0 | 1 |
| sgRCM104 | NGA | None | 0 | 0 | 0 | 51 | 1101 | 9541 | 0 | 0 | 1 | 0 |
| sgRCM104 | NGA | TS exon | 0 | 0 | 0 | 0 | 1 | 27 | 0 | 0 | 0 | 0 |
| sgRCM104 | NGG | Exon | 1 | 0 | 0 | 2 | 70 | 506 | 0 | 0 | 0 | 0 |
| sgRCM104 | NGG | None | 0 | 0 | 1 | 28 | 461 | 4267 | 0 | 2 | 0 | 1 |
| sgRCM104 | NGG | TS exon | 0 | 0 | 0 | 0 | 2 | 34 | 0 | 0 | 0 | 0 |

Example 27: Production of CD5-Targeting CAR-Ts

Figure 55:
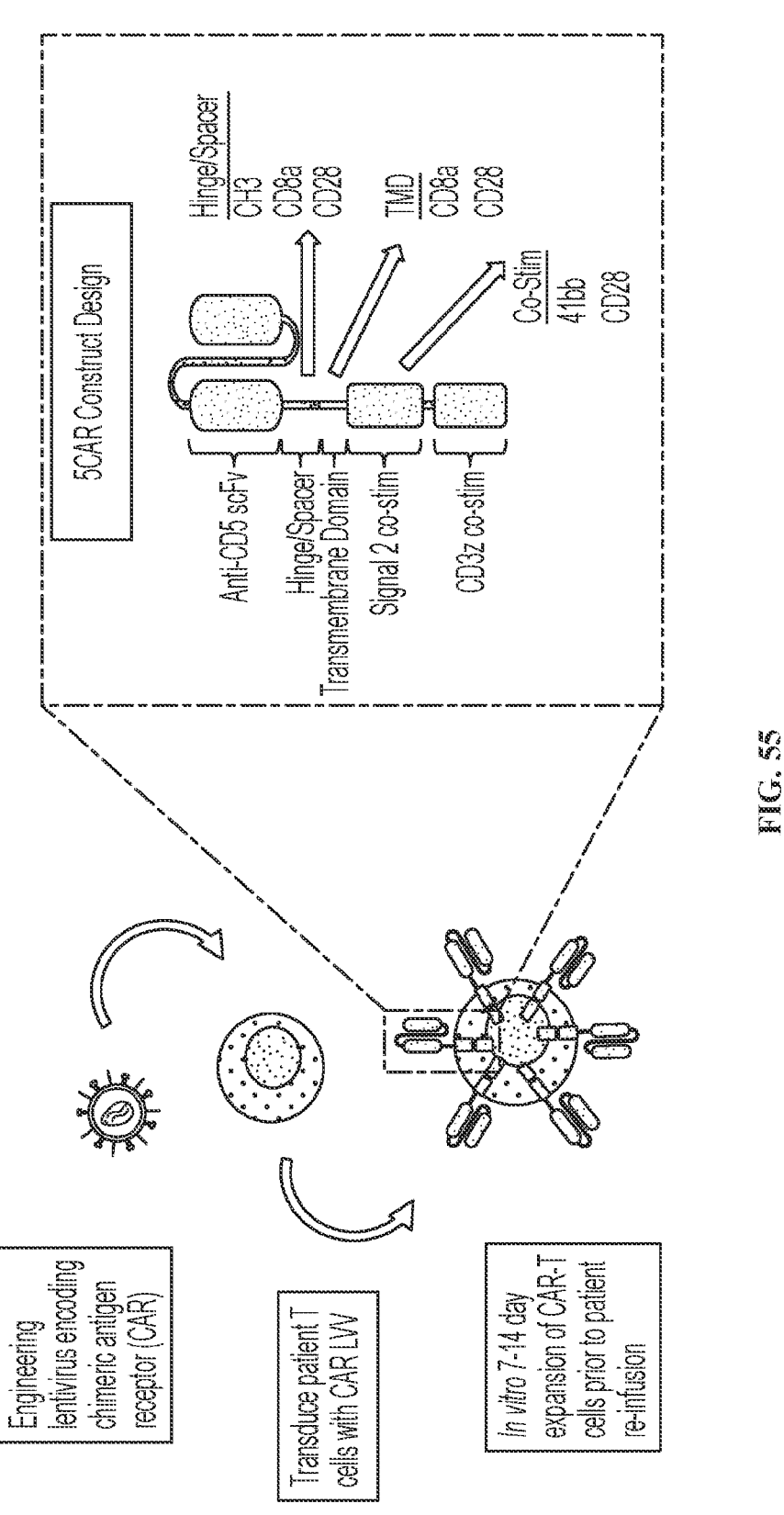
FIG. 55 is a schematic depicting production of an exemplary CD5 CAR construct.

In order to produce CD5-targeting CAR-T cells, a lenti-virus vector (LVV) was engineered encoding a CD5 CAR (FIG. 55). Patient T cells were transduced with the CD5 CAR LVV. In vitro 7-14 day expansion of the CAR-T cells was conducted prior to patient re-infusion. FIG. 55 shows exemplary CD5 CAR construct designs. An exemplary CD5 CAR construct design includes an anti-CD5 scFv, hinge/spacer, transmembrane domain, signal 2 co-stimulatory domain, and a CD3(co-stimulatory domain. The hinge/spacer region may include CH3, CD8u or CD28. The transmembrane domain may include CD8u or CD28. The Co-stimulatory domain may include 41bb or CD28.

Thirty LVV were generated. Table 28 below provides the various LVV CD5 CAR constructs.

TABLE 28

CD5 CAR LVV Constructs

| ID | Sequence |
|---|---|
| pCAR_BTx063 | MND-5CAR-CH3-CD28TM-CD28-CD3Z-WPRE codon opt 1 |
| pCAR_BTx064 | MND-5CAR-CH3-CD28TM-CD28-CD3Z-WPRE codon opt 2 |
| pCAR_BTx065 | MND-5CAR-CH3-CD28TM-CD28-CD3Z-WPRE codon opt 3 |
| pCAR_BTx066 | MND-5CAR-CD8aH-CD28TM-CD28-CD3Z-WPRE codon opt 1 |
| pCAR_BTx067 | MND-5CAR-CD8aH-CD28TM-CD28-CD3Z-WPRE codon opt 2 |
| pCAR_BTx068 | MND-5CAR-CD8aH-CD28TM-CD28-CD3Z-WPRE codon opt 3 |
| pCAR_BTx069 | MND-5CAR-CD28H-CD28TM-CD28-CD3Z-WPRE codon opt 1 |
| pCAR_BTx070 | MND-5CAR-CD28H-CD28TM-CD28-CD3Z-WPRE codon opt 2 |
| pCAR_BTx071 | MND-5CAR-CD28H-CD28TM-CD28-CD3Z-WPRE codon opt 3 |
| pCAR_BTx072 | MND-5CAR-CH3-CD8aTM-41BB-CD3Z-WPRE codon opt 1 |
| pCAR_BTx073 | MND-5CAR-CH3-CD8aTM-41BB-CD3Z-WPRE codon opt 2 |
| pCAR_BTx074 | MND-5CAR-CH3-CD8aTM-41BB-CD3Z-WPRE codon opt 3 |
| pCAR_BTx075 | MND-5CAR-CD8aH-CD8aTM-41BB-CD3Z-WPRE codon opt 1 |
| pCAR_BTx076 | MND-5CAR-CD8aH-CD8aTM-41BB-CD3Z-WPRE codon opt 2 |
| pCAR_BTx077 | MND-5CAR-CD8aH-CD8aTM-41BB-CD3Z-WPRE codon opt 3 |
| pCAR_BTx078 | PGK-5CAR-CH3-CD28TM-CD28-CD3Z-WPRE codon opt 1 |
| pCAR_BTx079 | PGK-5CAR-CH3-CD28TM-CD28-CD3Z-WPRE codon opt 2 |
| pCAR_BTx080 | PGK-5CAR-CH3-CD28TM-CD28-CD3Z-WPRE codon opt 3 |
| pCAR_BTx081 | PGK-5CAR-CD8aH-CD28TM-CD28-CD3Z-WPRE codon opt 1 |
| pCAR_BTx082 | PGK-5CAR-CD8aH-CD28TM-CD28-CD3Z-WPRE codon opt 2 |
| pCAR_BTx083 | PGK-5CAR-CD8aH-CD28TM-CD28-CD3Z-WPRE codon opt 3 |
| pCAR_BTx084 | PGK-5CAR-CD28H-CD28TM-CD28-CD3Z-WPRE codon opt 1 |
| pCAR_BTx085 | PGK-5CAR-CD28H-CD28TM-CD28-CD3Z-WPRE codon opt 2 |
| pCAR_BTx086 | PGK-5CAR-CD28H-CD28TM-CD28-CD3Z-WPRE codon opt 3 |
| pCAR_BTx087 | PGK-5CAR-CH3-CD8aTM-41BB-CD3Z-WPRE codon opt 1 |
| pCAR_BTx088 | PGK-5CAR-CH3-CD8aTM-41BB-CD3Z-WPRE codon opt 2 |
| pCAR_BTx089 | PGK-5CAR-CH3-CD8aTM-41BB-CD3Z-WPRE codon opt 3 |
| pCAR_BTx090 | PGK-5CAR-CD8aH-CD8aTM-41BB-CD3Z-WPRE codon opt 1 |
| pCAR_BTx091 | PGK-5CAR-CD8aH-CD8aTM-41BB-CD3Z-WPRE codon opt 2 |
| pCAR_BTx092 | PGK-5CAR-CD28H-CD28TM-CD28-CD3Z-WPRE codon opt 1 |

TABLE 29

CD5 CAR Constructs

| ID | Sequence |
|---|---|
| UTD | Untransduced (no lentivirus) |
| pCAR_BTx063 | MND-5CAR-CH3-CD28TM-CD28-CD3Z-WPRE |
| pCAR_BTx067 | MND-5CAR-CD8aH-CD28TM-CD28-CD3Z-WPRE |
| pCAR_BTx071 | MND-5CAR-CD28H-CD28TM-CD28-CD3Z-WPRE |

In order to further characterize CD5 LVV CAR-T cells in vitro, a live imaging cell killing assay was performed. CD5 LVV CAR-T cells (LV66, LV67, LV68, and LV69) were added to CCRF tumor cells. As shown in FIGS. 57A-57D, edited and unedited constructs were cytotoxic against CD5+ CCRF cells.

Figure 56:
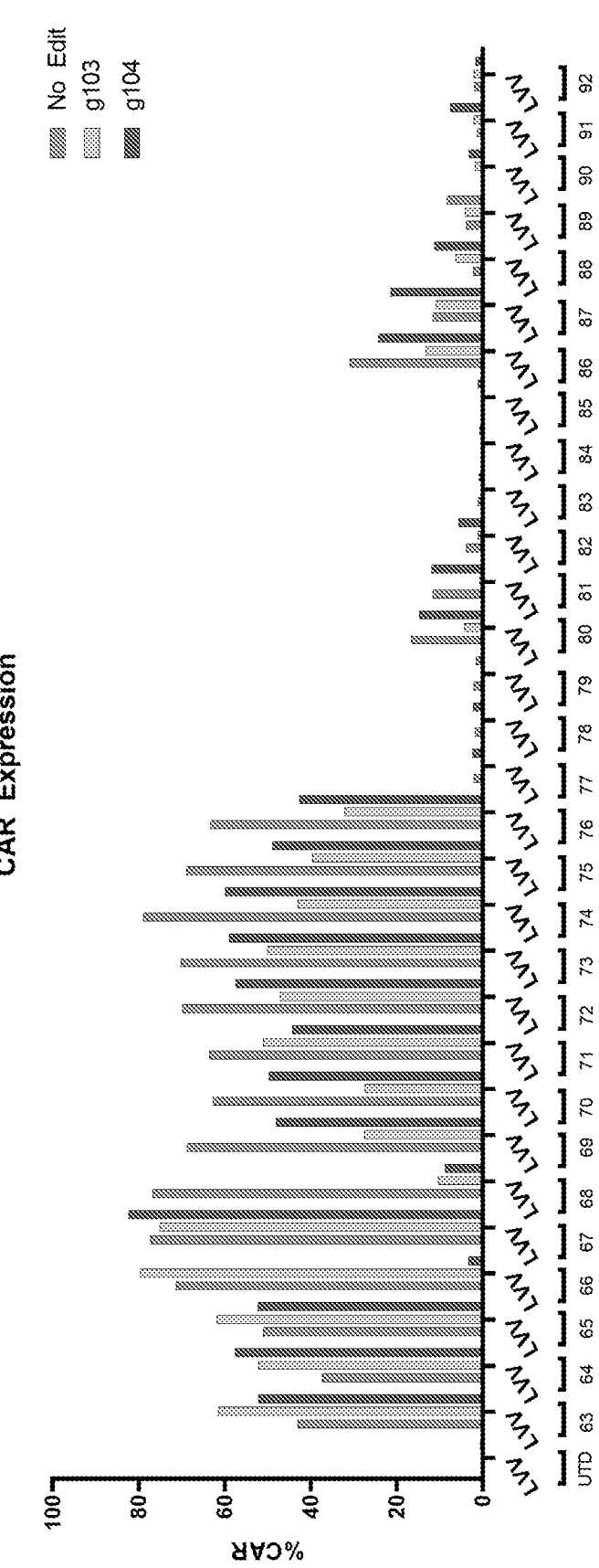
FIG. 56 is a graph depicting CAR expression from a lentiviral vector (LVV) screen using CD5 gRNA candidates g103 and g104.

Each of the CD5 CAR LVV constructs from Table 27 with either the MND promoter or the PGK promoter were screened to examine CAR expression in primary human T cells using either sgRNA 103 and sgRNA 104. Untransduced (UTD) cells were used as a control. As shown in FIG. 56, the CD5 CAR LVV constructs resulted in having CAR expression ranging from 0% to 82%. Twenty-four constructs showed detectable CAR expression on the surface of T cells at the end of the 10 day culture period.

Figure 57:
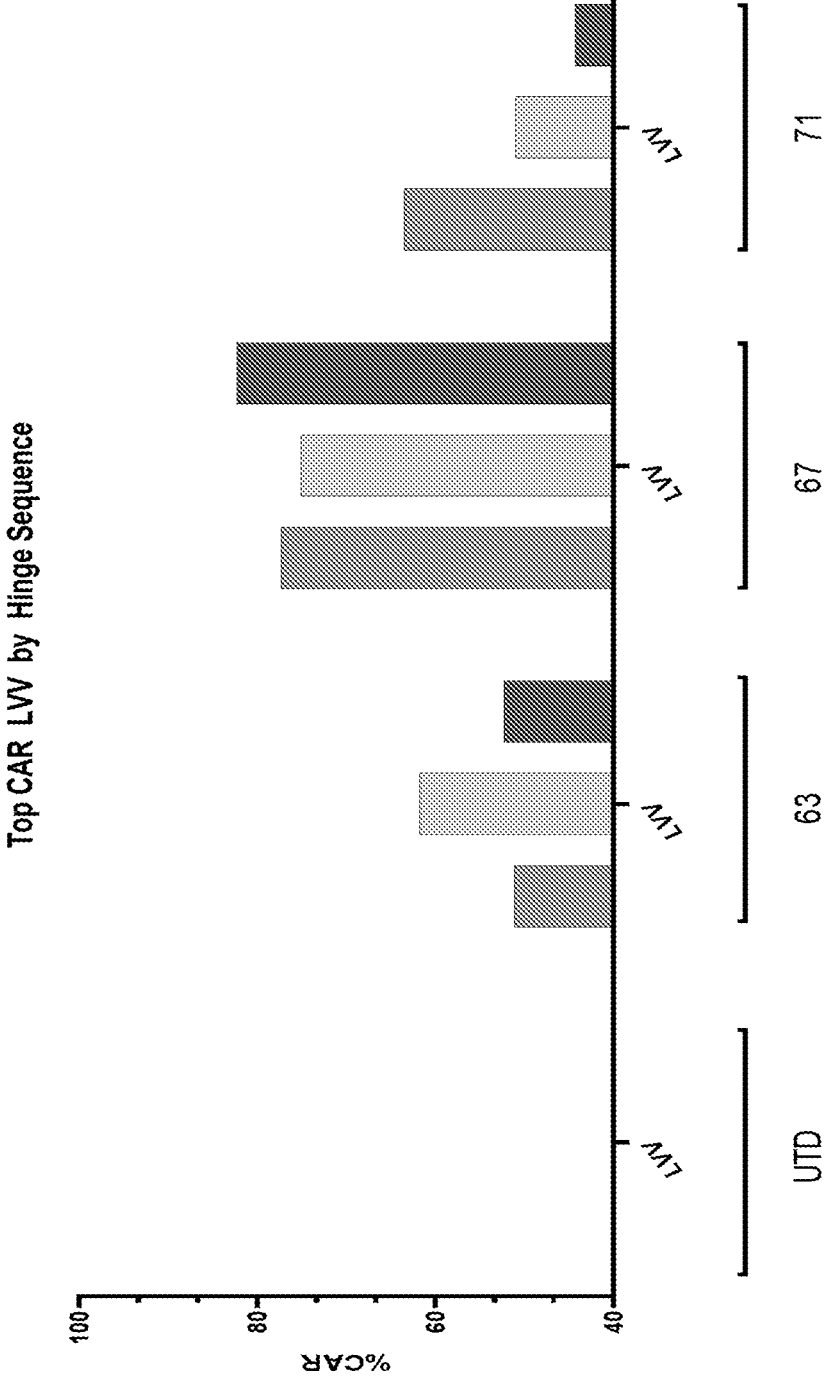
FIG. 57 is a graph depicting CAR LVV expression based on hinge sequence.
Figures 58A, 58B, 58C, 58D:
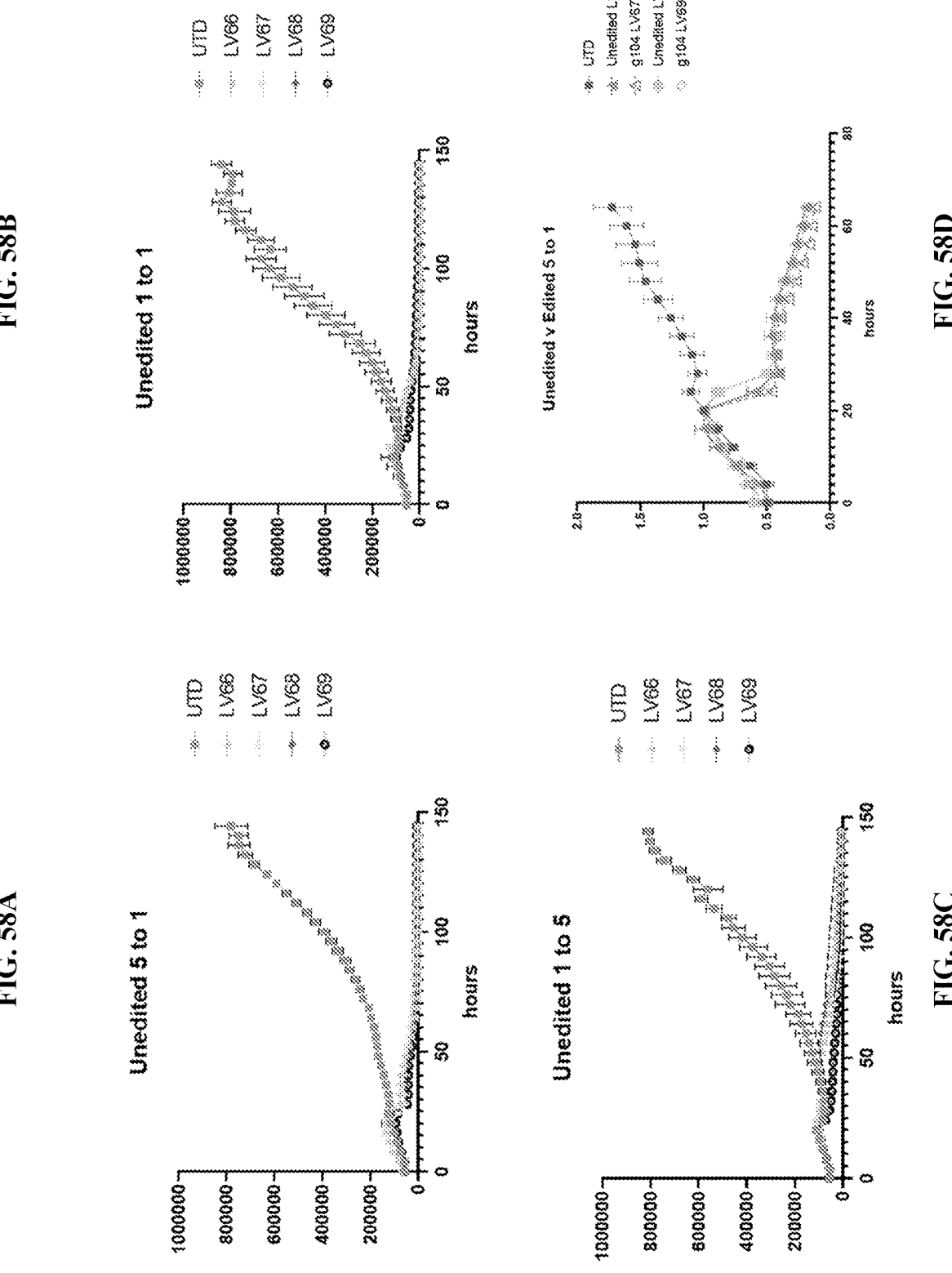
FIGS. 58A-58D are graphs depicting edited and unedited constructs are fully cytotoxic against CD5+ CCRF in live imaging cell killing assay.

To determine whether the hinge/spacer CAR construct sequence affected CAR expression, the CAR constructs in Table 29 containing different hinge/spacer sequences (in bold font) were examined in combination with either sgRNA 103 and sgRNA 104. Untransduced (UTD) cells were used as a control. As shown in FIG. 57, the hinge/spacer sequence did impact CAR expression.

Figure 59B:
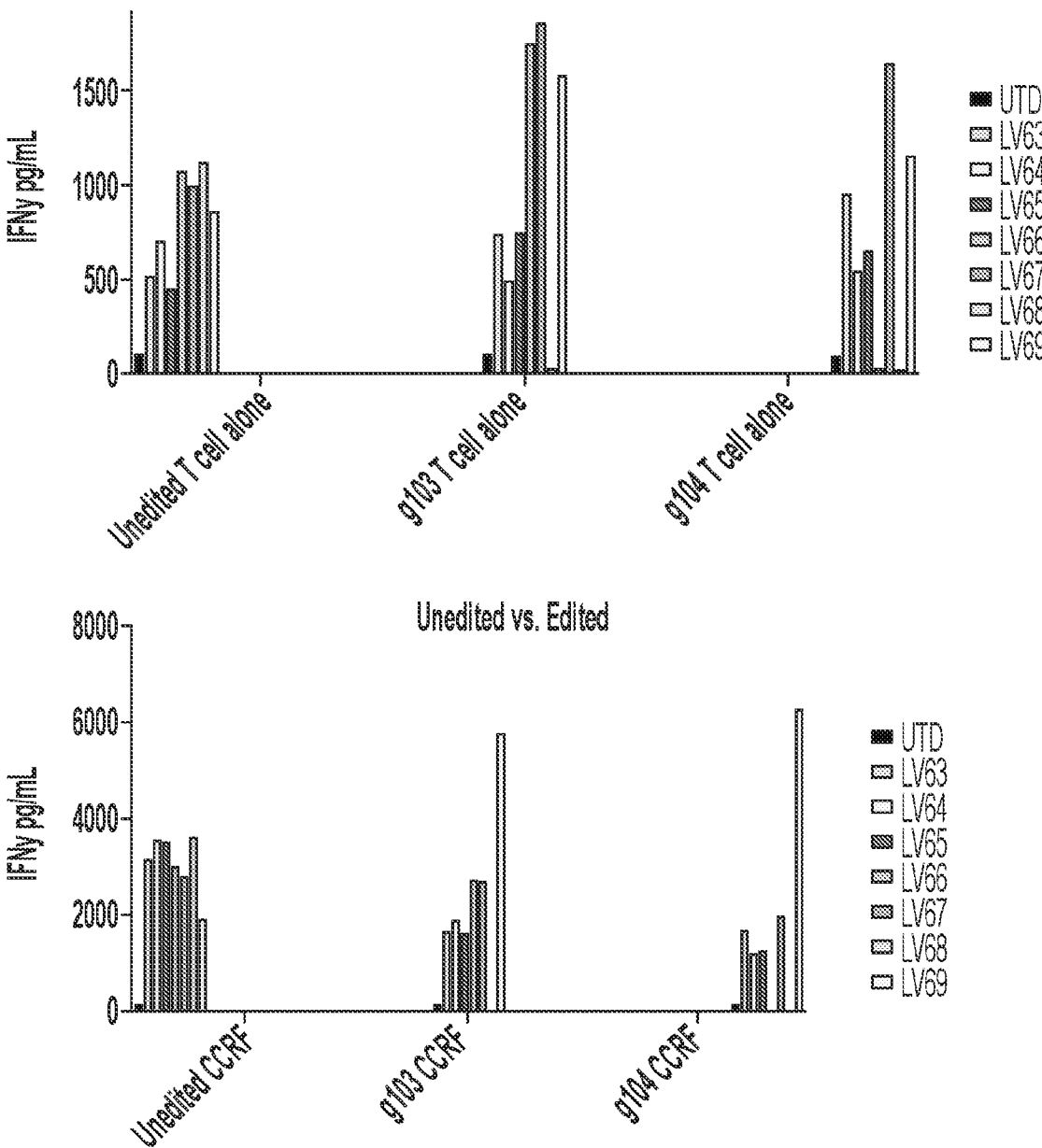

CD5 CAR constructs (LV63-LV69) were evaluated in vitro for IFNγ production using either sgRNA 103 and sgRNA 104 in T cells alone or in CCRF cells (FIGS. 59A and 59B). All CD5 CAR constructs released IFNγ in the presence of CD5+ CCRF-CEM leukemia cell lines.

Example 28: Combination Therapy Using Multiple Modified Immune Effector Cells To examine whether the use of multiple genetically modified CAR-T cells can enhance the treatment of patients with T- or NK-Cell malignancies, such as liquid cancers, patients were administered one or more modified CAR-T cell based on their immunophenotype. Immune cells from patient samples were immunophenotyped for the presence or absence of CD5, CD7, CD33, and CD123 using flow cytometry and/or sequence analysis. mRNA base editors and guide RNA were delivered into the immune cells by electroporation to edit either CD5, CD7, CD33, or CD123 in combination with one or more of TRAC, LAG-3, FAS, CD52, B2M, CIITA, TRBC1, TRBC2, and PD-1 to reduce and or eliminate expression of these genes in the immune cells. Following base editing, the CD5 CAR, CD7 CAR, CD33 CAR, or CD123 CAR was delivered into modified immune cells via lentiviral transduction to create CD5, CD7, CD33 and CD123 CAR-T cells, respectively.

Patients that were immunophenotyped as CD5$^+$ CD7$^-$ were treated with a CD5 CAR-T cell or population thereof. Patients that were immunophenotyped as CD5$^-$ CD7$^+$ were treated with a CD7 CAR-T cell or population thereof. Patients that were immunophenotyped as CD5$^+$ CD7$^+$ were treated with a CD5 CAR-T cell or population thereof and/or a CD7 CAR-T cell or population thereof. Patients that were immunophenotyped as CD33– CD123+ were treated with a CD123 CAR-T cell or population thereof. Patients that were immunophenotyped as CD33+ CD123– were treated with a CD33 CAR-T cell or population thereof. Patients that were immunophenotyped as CD33+ CD123+ were treated with a CD33 CAR-T cell or population thereof and/or a CD123 CAR-T cell or population thereof. Patients that were immunophenotyped as CD5$^+$ CD7$^+$ CD33$^+$ CD123+ were treated with any combination of a CD33 CAR-T cell or population thereof, a CD5 CAR-T cell or population thereof, a CD7 CAR-T cell or population thereof, and/or a CD123 CAR-T cell or population thereof.

OTHER EMBODIMENTS

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All publications, patents and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

SEQUENCE LISTING (1512 sequences)

SEQ ID NO: 1 - RNA, 20 nt, Artificial Sequence
  Description of Artificial Sequence: Synthetic oligonucleotide
agcgacugcagaaagaagag

SEQ ID NO: 2 - RNA, 20 nt, Artificial Sequence
  Description of Artificial Sequence: Synthetic oligonucleotide
cauaccagcugagccguccg

SEQ ID NO: 3 - protein, 573 aa, Artificial Sequence
  Description of Artificial Sequence: Synthetic polypeptide
MEFGLSWLFLVAILKGVQCIDAMGNIQLVQSGPELKKPGETVKISCKASGYTFTNYGMNWVKQAPGKGLRWMGWINTHTGEPTYADDFKGRFAFSLETSASTAYLQINNLKNEDTATYFCTRRGYDWYFDVWGAGTTVTVSSGGGGSGGGGSGGGGSDIKMTQSPSSMYASLGERVTITCKASQDINSYLSWFHHKPGKSPKTLIYRANRLVDGVPSRFSGSGSGQDYSLTISSLDYEDMGIYYCQQYDESPWTFGGGTKLEMKGSGDPAEPKSPDKTHTCPGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4 - protein, 495 aa, Artificial Sequence
  Description of Artificial Sequence: Synthetic polypeptide
MEFGLSWLFLVAILKGVQCIDAMGNIQLVQSGPELKKPGETVKISCKASGYTFTNYGMNWVKQAPGKGLRWMGWINTHTGEPTYADDFKGRFAFSLETSASTAYLQINNLKNEDTATYFCTRRGYDWYFDVWGAGTTVTVSSGGGGSGGGGSGGGGSDIKMTQSPSSMYASLGERVTITCKASQDINSYLSWFHHKPGKSPKTLIYRANRLVDGVPSRFSGSGSGQDYSLTISSLDYEDMGIYYCQQYDESPWTFGGGTKLEMKGSGDPATTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5 - protein, 489 aa, Artificial Sequence
  Description of Artificial Sequence: Synthetic polypeptide
MEFGLSWLFLVAILKGVQCIDAMGNIQLVQSGPELKKPGETVKISCKASGYTFTNYGMNWVKQAPGKGLRWMGWINTHTGEPTYADDFKGRFAFSLETSASTAYLQINNLKNEDTATYFCTRRGYDWYFDVWGAGTTVTVSSGGGGSGGGGSGGGGSDIKMTQSPSSMYASLGERVTITCKASQDINSYLSWFHHKPGKSPKTLIYRANRLVDGVPSRFSGSGSGQDYSLTISSLDYEDMGIYYCQQYDESPWTFGGGTKLEMKGSGDPAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6 - protein, 617 aa, Artificial Sequence
  Description of Artificial Sequence: Synthetic polypeptide
MEFGLSWLFLVAILKGVQCIDAMGNIQLVQSGPELKKPGETVKISCKASGYTFTNYGMNWVKQAPGKGLRWMGWINTHTGEPTYADDFKGRFAFSLETSASTAYLQINNLKNEDTATYFCTRRGYDWYFDVWGAGTTVTVSSGGGGSGGGGSGGGGSDIKMTQSPSSMYASLGERVTITCKASQDINSYLSWFHHKPGKSPKTLIYRANRLVDGVPSRFSGSGSGQDYSLTISSLDYEDMGIYYCQQYDESPWTFGGGTKLEMKGSGDPAEPKSPDKTHTCPGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7 - protein, 490 aa, Artificial Sequence
  Description of Artificial Sequence: Synthetic polypeptide
  MOD_RES (490)..(490): Any amino acid
MEFGLSWLFLVAILKGVQCIDAMGNIQLVQSGPELKKPGETVKISCKASGYTFTNYGMNWVKQAPGKGLRWMGWINTHTGEPTYADDFKGRFAFSLETSASTAYLQINNLKNEDTATYFCTRRGYDWYFDVWGAGTTVTVSSGGGGSGGGGSGGGGSDIKMTQSPSSMYASLGERVTITCKASQDINSYLSWFHHKPGKSPKTLIYRANRLVDGVPSRFSGSGSGQDYSLTISSLDYEDMGIYYCQQYDESPWTFGGGTKLEMKGSGDPATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRDPEMGGKPRRKNPQEGLYNELQKDKMAEAYSEIGMKGERRRGKGHDGLYQGLSTATKDDALHMQALPPRX

SEQ ID NO: 8 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 9 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 10 - DNA, 994 bp, Homo sapiens
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 11 - DNA, 8811 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 12 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTD

SEQ ID NO: 13 - DNA, 8877 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagcccatgcggcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 14 - DNA, 5508 bp, Artificial Sequence
  Description of Artificial Sequence: Synthetic polynucleotide
atgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagccgcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctaaaaggacggcggacggatcagagttcgagagtccgaaaaaaaaacgaaaggtcgaataa

SEQ ID NO: 15 - DNA, 5514 bp, Artificial Sequence
  Description of Artificial Sequence: Synthetic polynucleotide
atgtcatccgaaaccgggccagtggccgtagacccaacactcaggaggcggatagaaccccatgagtttgaagtgttcttcgaccccagagagctgcgcaaagagacttgcctcctgtatgaaataaattgggggggtcgccattcaatttggaggcacactagccagaatactaacaaacacgtggaggtaaattttatcgagaagtttaccaccgaaagatacttttgccccaatacacggtgttcaattacctggtttctgtcatggagtccatgtggagaatgtagtagagcgataactgagttcctgtctcgatatcctcacgtcacgttgtttatatacatcgctcggctttatcaccatgcggacccgcggaacaggcaaggtcttcgggacctcatatcctctggggtgaccatccagataatgacggagcaagagagcggatactgctggcgaaactttgttaactacagcccaagcaatgaggcacactggcctagatatccgcatctctgggttcgactgtatgtccttgaactgtactgcataattctgggacttccgccatgcttgaacattctgcggcggaaacaaccacagctgacctttttcacgattgctctccaaagttgtcactaccagcgattgccaccccacatcttgtgggctactggactcaagtctggaggaagttcaggcggaagcagcgggtctgaaacgcccggaacctcagagagcgcaacgcccgaaagctctggagggtcaagtggtggtagtgataagaaatactccatcggcctcgccatcggtacgaattctgtcggttgggccgttatcaccgatgagtacaaggtcccttctaagaaattcaaggttttgggcaatacagaccgccattctataaaaaaaaacctgatcggcgcccttttgtttgacagtggtgagactgctgaagcgactcgcctgaagcgaactgccaggaggcggtatacgaggcgaaaaaaccgaatttgttacctccaggagattttctcaaatgaaatggccaaggtagatgatagtttttttcaccgcttggaagaaagttttctcgttgaggaggacaaaaagcacgagaggcacccaatctttggcaacatagtcgatgaggtcgcataccatgagaaatatcctacgatctatcatctccgcaagaagctggtcgatagcacggataaagctgacctccggctgatctaccttgctcttgctcacatgattaaattcaggggccatttcctgatagaaggagacctcaatcccgacaattctgatgtcgacaaactgtttattcagctcgttcagacctataatcaactctttgaggagaaccccatcaatgcttcaggggtggacgcaaaggccattttgtccgcgcgcttgagtaaatcacgacgcctcgagaatttgatagctcaactgccgggtgagaagaaaaacgggttgtttgggaatctcatagcgttgagtttgggacttacgccaaactttaagtctaactttgatttggccgaagatgccaaattgcagctgtccaaagatacctatgatgacgacttggataaccttcttgcgcagattggtgaccaatacgcggatctgtttcttgccgcaaaaaatctgtccgacgccatactcttgtccgatatactgcgcgtcaatactgagataactaaggctcccctcagcgcgtccatgattaaaagatacgatgagcaccaccaagatctcactctgttgaaagccctggttcgccagcagcttccagagaagtataaggagatatttttcgaccaatctaaaaacggctatgcgggttacattgacggtggcgcctctcaagaagaattctacaagtttataaagccgatacttgagaaaatggacggtacagaggaattgttggttaagctcaatcgcgaggacttgttgagaaagcagcgcacatttgacaatggtagtattccacaccagattcatctgggcgagttgcatgccattcttagaagacaagaagatttttatccgtttctgaaagataacagagaaaagattgaaaagatacttacctttcgcataccgtattatgtaggtcccctggctagagggaacagtcgcttcgcttggatgactcgaaaatcagaagaaacaataaccccctggaattttgaagaagtggtagataaaggtgcgagtgcccaatcttttattgagcggatgacaaattttgacaagaatctgcctaacgaaaaggtgcttcccaagcattcccttttgtatgaatactttacagtatataatgaactgactaaagtgaagtacgttaccgaggggatgcgaaagccagcttttctcagtggcgagcagaaaaaagcaatagttgacctgctgttcaagacgaataggaaggttaccgtcaaacagctcaaagaagattactttaaaaagatcgaatgttttgattcagttgagataagcggagtagaggatagatttaacgcaagtcttggaacttatcatgaccttttgaagatcatcaaggataaagattttttggacaacgaggagaatgaagatatcctggaagatatagtacttaccttgacgctttttgaagatcgagagatgatcgaggagcgacttaagacgtacgcacatctctttgacgataaggttatgaaacaattgaaacgccggcggtatactggctggggcaggctttctcgaaagctgattaatggtatccgcgataagcagtctggaaagacaatccttgactttctgaaaagtgatggatttgcaaatagaaactttatgcagcttatacatgatgactctttgacgttcaaggaagacatccagaaggcacaggtatccggccaaggggatagcctccatgaacacatagccaacctggccggctcaccagctattaaaaagggaatattgcaaaccgttaaggttgttgacgaactcgttaaggttatgggccgacacaaaccagagaatatcgtgattgagatggctagggagaatcagaccactcaaaaaggtcagaaaaattctcgcgaaaggatgaagcgaattgaagagggaatcaaagaacttggctctcaaattttgaaagagcacccggtagaaaacactcagctgcagaatgaaaagctgtatctgtattatctgcagaatggtcgagatatgtacgttgatcaggagctggatatcaataggctcagtgactacgatgtcgaccacatcgttcctcaatctttcctgaaagatgactctatcgacaacaaagtgttgacgcgatcagataagaaccggggaaaatccgacaatgtaccctcagaagaagttgtcaagaagatgaaaaactattggagacaattgctgaacgccaagctcataacacaacgcaagttcgataacttgacgaaagccgaaagaggtgggttgtcagaattggacaaagctggctttattaagcgccaattggtggagacccggcagattacgaaacacgtagcacaaattttggattcacgaatgaataccaaatacgacgaaaacgacaaattgatacgcgaggtgaaagtgattacgcttaagagtaagttggtttccgatttcaggaaggattttcagttttacaaagtaagagaaataaacaactaccaccacgcccatgatgcttacctcaacgcggtagttggcacagctcttatcaaaaaatatccaaagctggaaagcgagttcgtttacggtgactataaagtatacgacgttcggaagatgatagccaaatcagagcaggaaattgggaaggcaaccgcaaaatacttcttctattcaaacatcatgaacttctttaagacggagattacgctcgcgaacggcgaaatacgcaagaggcccctcatagagactaacggcgaaaccggggagatcgtatgggacaaaggacgggactttgcgaccgttagaaaagtactttcaatgccacaagtgaatattgttaaaaagacagaagtacaaacaggggggttcagtaaggaatccattttgcccaagcggaacagtgataaattgatagcaaggaaaaaagattgggaccctaagaagtacggtggtttcgactctcctaccgttgcatattcagtccttgtagttgcgaaagtggaaaaggggaaaagtaagaagcttaagagtgttaaagagcttctgggcataaccataatggaacggtctagcttcgagaaaaatccaattgactttctcgaggctaaaggttacaaggaggtaaaaaaggacctgataattaaactcccaaagtacagtctcttcgagttggagaatgggaggaagagaatgttggcatctgcaggggagctccaaaaggggaacgagctggctctgccttcaaaatacgtgaactttctgtacctggccagccactacgagaaactcaagggttctcctgaggataacgagcagaaacagctgtttgtagagcagcacaagcattacctggacgagataattgagcaaattagtgagttctcaaaaagagtaatccttgcagacgcgaatctggataaagttctttccgcctataataagcaccgggacaagcctatacgagaacaagccgagaacatcattcacctctttacccttactaatctgggcgcgccggccgccttcaaatacttcgacaccacgatagacaggaaaaggtatacgagtaccaaagaagtacttgacgccactctcatccaccagtctataacagggttgtacgaaacgaggatagatttgtcccagctcggcggcgactcaggagggtcaggcggctccggtggatcaacgaatctttccgacataatcgagaaagaaaccggcaaacagttggtgatccaagaatcaatcctgatgctgcctgaagaagtagaagaggtgattggcaacaaacctgagtctgacattcttgtccacaccgcgtatgacgagagcacggacgagaacgttatgcttctcactagcgacgcccctgagtataaaccatgggcgctggtcatccaagattccaatggggaaaacaagattaagatgcttagtggtgggtctggagggagcggtgggtccacgaacctcagcgacattattgaaaaagagactggtaaacaacttgtaatacaagagtctattctgatgttgcctgaagaggtggaggaggtgattgggaacaaaccggagtctgatatacttgttcataccgcctatgacgaatctactgatgagaatgtgatgcttttaacgtcagacgctcccgagtacaaaccctgggctctggtgattcaggacagcaatggtgagaataagattaaaatgttgagtgggggctcaaagcgcacggctgacggtagcgaatttgagagccccaaaaaaaaacgaaaggtcgaataa

SEQ ID NO: 16 - DNA, 5514 bp, Artificial Sequence
  Description of Artificial Sequence: Synthetic polynucleotide
atgagcagcgagacaggccctgtggctgtggatcctacactgcggagaagaatcgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggactgcgcgacctgatcagcagcggagtgaccatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagagcggaggatctagcggcggctctagcggatctgagacacctggcacaagcgagtctgccacacctgagagtagcggcggatcttctggcggctccgacaagaagtactctatcggactggccatcggcaccaactctgttggatgggccgtgatcaccgacgagtacaaggtgcccagcaagaaattcaaggtgctgggcaacaccgaccggcacagcatcaagaagaatctgatcggcgccctgctgttcgactctggcgaaacagccgaagccaccagactgaagagaaccgccaggcggagatacacccggcggaagaaccggatctgctacctgcaagagatcttcagcaacgagatggccaaggtggacgacagcttcttccacagactggaagagtccttcctggtggaagaggacaagaagcacgagcggcaccccatcttcggcaacatcgtggatgaggtggcctaccacgagaagtaccccaccatctaccacctgagaaagaaactggtggacagcaccgacaaggccgacctgagactgatctacctggctctggcccacatgatcaagttccggggccactttctgatcgagggcgatctgaaccccgacaacagcgacgtggacaagctgttcatccagctggtgcagacctacaaccagctgttcgaggaaaaccccatcaacgcctctggcgtggacgccaaggctatcctgtctgccagactgagcaagagcagaaggctggaaaacctgatcgcccagctgcctggcgagaagaagaatggcctgttcggcaacctgattgccctgagcctgggactgacccctaacttcaagagcaacttcgacctggccgaggatgccaaactgcagctgagcaaggacacctacgacgacgacctggacaatctgctggcccagatcggcgatcagtacgccgacttgtttctggccgccaagaacctgtccgacgccatcctgctgagcgatatcctgagagtgaacaccgagatcacaaaggcccctctgagcgcctctatgatcaagagatacgacgagcaccaccaggatctgaccctgctgaaggccctcgttagacagcagctgccagagaagtacaaagagattttcttcgatcagtccaagaacggctacgccggctacattgatggcggagccagccaagaggaattctacaagttcatcaagcccatcctggaaaagatggacggcaccgaggaactgctggtcaagctgaacagagaggacctgctgcggaagcagcggaccttcgacaatggctctatccctcaccagatccacctgggagagctgcacgccattctgcggagacaagaggacttttacccattcctgaaggacaaccgggaaaagatcgagaagatcctgaccttcaggatcccctactacgtgggaccactggccagaggcaatagcagattcgcctggatgaccagaaagagcgaggaaaccatcacaccctggaacttcgaggaagtggtggacaagggcgccagcgctcagtccttcatcgagcggatgaccaacttcgataagaacctgcctaacgagaaggtgctgcccaagcactccctgctgtatgagtacttcaccgtgtacaacgagctgaccaaagtgaaatacgtgaccgagggaatgagaaagcccgcctttctgagcggcgagcagaaaaaggccattgtggatctgctgttcaagaccaaccggaaagtgaccgtgaagcagctgaaagaggactacttcaagaaaatcgagtgcttcgacagcgtggaaatcagcggcgtggaagatcggttcaatgccagcctgggcacataccacgacctgctgaaaattatcaaggacaaggacttcctggacaacgaagagaacgaggacattctcgaggacatcgtgctgaccctgacactgtttgaggacagagagatgatcgaggaacggctgaaaacatacgcccacctgttcgacgacaaagtgatgaagcaactgaagcggaggcggtacacaggctggggcagactgtctcggaagctgatcaacggcatccgggataagcagtccggcaagacaatcctggatttcctgaagtccgacggcttcgccaacagaaacttcatgcagctgatccacgacgacagcctgacctttaaagaggacatccagaaagcccaggtgtccggccaaggcgattctctgcacgagcacattgccaacctggccggatctcccgccattaagaagggcatcctgcagacagtgaaggtggtggacgagcttgtgaaagtgatgggcagacacaagcccgagaacatcgtgatcgaaatggccagagagaaccagaccacacagaagggccagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaaccggctgagcgactacgatgtggaccatatcgtgccccagagctttctgaaggacgactccatcgataacaaggtcctgaccagaagcgacaagaaccggggcaagagcgataacgtgccctccgaagaggtggtcaagaagatgaagaactactggcgacagctgctgaacgccaagctgattacccagcggaagttcgataacctgaccaaggccgagagaggcggcctgagcgaacttgataaggccggcttcattaagcggcagctggtggaaacccggcagatcaccaaacacgtggcacagattctggactcccggatgaacactaagtacgacgagaatgacaagctgatccgggaagtgaaagtcatcaccctgaagtctaagctggtgtccgatttccggaaggatttccagttctacaaagtgcgggaaatcaacaactaccatcacgcccacgacgcctacctgaatgccgttgttggaacagccctgatcaagaagtatcccaagctggaaagcgagttcgtgtacggcgactacaaggtgtacgacgtgcggaagatgatcgccaagagcgaacaagagatcggcaaggctaccgccaagtactttttctacagcaacatcatgaactttttcaagacagagatcaccctggccaacggcgagatccggaaaagacccctgatcgagacaaacggcgaaaccggggagatcgtgtgggataagggcagagattttgccacagtgcggaaagtgctgagcatgccccaagtgaatatcgtgaagaaaaccgaggtgcagacaggcggcttcagcaaagagtctatcctgcctaagcggaacagcgataagctgatcgccagaaagaaggactgggaccctaagaagtacggcggcttcgatagccctaccgtggcctattctgtgctggtggtggccaaagtggaaaagggcaagtccaaaaagctcaagagcgtgaaagagctgctggggatcaccatcatggaaagaagcagctttgagaagaacccgatcgactttctggaagccaagggctacaaagaagtcaagaaggacctcatcatcaagctccccaagtacagcctgttcgagctggaaaatggccggaagcggatgctggcctcagcaggcgaactgcagaaaggcaatgaactggccctgcctagcaaatacgtcaacttcctgtacctggccagccactatgagaagctgaagggcagccccgaggacaatgagcaaaagcagctgtttgtggaacagcacaagcactacctggacgagatcatcgagcagatcagcgagttctccaagagagtgatcctggccgacgctaacctggataaggtgctgtctgcctataacaagcaccgggacaagcctatcagagagcaggccgagaatatcatccacctgtttaccctgaccaacctgggagcccctgccgccttcaagtacttcgacaccaccatcgaccggaagaggtacaccagcaccaaagaggtgctggacgccacactgatccaccagtctatcaccggcctgtacgaaacccggatcgacctgtctcagctcggcggcgattctggtggttctggcggaagtggcggatccaccaatctgagcgacatcatcgaaaaagagacaggcaagcagctcgtgatccaagaatccatcctgatgctgcctgaagaggttgaggaagtgatcggcaacaagcctgagtccgacatcctggtgcacaccgcctacgatgagagcaccgatgagaacgtcatgctgctgacaagcgacgcccctgagtacaagccttgggctctcgtgattcaggacagcaatggggagaacaagatcaagatgctgagcggaggtagcggaggcagtggcggaagcacaaacctgtctgatatcattgaaaaagaaaccgggaagcaactggtcattcaagagtccattctcatgctcccggaagaagtcgaggaagtcattggaaacaaacccgagagcgatattctggtccacacagcctatgacgagtctacagacgaaaacgtgatgctcctgacctctgacgctcccgagtataagccctgggcacttgttatccaggactctaacggggaaaacaaaatcaaaatgttgtccggcggcagcaagcggacagccgatggatctgagttcgagagccccaagaagaaacggaaggtggagtaa

SEQ ID NO: 17 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 18 - DNA, 9199 bp, Homo sapiens
catgtcataaatggtaagtccaagaaaaatacaggtattcccccccaaagaaaactgtaaaatcgacttttttctatctgtactgttttttattggtttttaaattggttttccaagtgagtaaatcagaatctatctgtaatggattttaaatttagtgtttctctgtgatgtagtaaacaagaaactagaggcaaaaatagccctgtcccttgctaaacttctaaggcacttttctagtacaactcaacactaacatttcaggcctttagtgccttatatgagtttttaaaagggggaaaagggagggagcaagagtgtcttaactcatacatttaggcataacaattattctcatattttagttattgagagggctggtagaaaaactaggtaaataatattaataattatagcgcttattaaacactacagaacacttactatgtaccaggcattgtgggaggctctctcttgtgcattatctcatttcattaggtccatggagagtattgcattttcttagtttaggcatggcctccacaataaagattatcaaaagcctaaaaatatgtaaaagaaacctagaagttatttgttgtgctccttggggaagctaggcaaatcctttcaactgaaaaccatggtgacttccaagatctctgcccctccccatcgccatggtccacttcctcttctcactgttcctcttagaaaagatctgtggactccaccaccacgaaatggcggcaccttatttatggtcactttagagggtaggttttcttaatgggtctgcctgtcatgtttaacgtccttggctgggtccaaggcagatgcagtccaaactctcactaaaattgccgagccctttgtcttccagtgtctaaaatattaatgtcaatggaatcaggccagagtttgaattctagtctcttagcctttgtttcccctgtccataaaatgaatgggggtaattctttcctcctacagtttatttatatattcactaattcattcattcatccatccattcgttcattcggtttactgagtacctactatgtgccagcccctgttctagggtggaaactaagagaatgatgtacctagagggcgctggaagctctaaagccctagcagttactgcttttactattagtggtcgtttttttctcccccccgccccccgacaaatcaacagaacaaagaaaattacctaaacagcaaggacatagggaggaacttcttggcacagaactttccaaacactttttcctgaagggatacaagaagcaagaaaggtactctttcactaggaccttctctgagctgtcctcaggatgcttttgggactatttttcttacccagagaatggagaaaccctgcagggaattcccaagctgtagttataaacagaagttctccttctgctaggtagcattcaaagatcttaatcttctgggtttccgttttctcgaatgaaaaatgcaggtccgagcagttaactggctggggcaccattagcaagtcacttagcatctctggggccagtctgcaaagcgagggggcagccttaatgtgcctccagcctgaagtcctagaatgagcgcccggtgtcccaagctggggcgcgcaccccagatcggagggcgccgatgtacagacagcaaactcacccagtctagtgcatgccttcttaaacatcacgagactctaagaaaaggaaactgaaaacgggaaagtccctctctctaacctggcactgcgtcgctggcttggagacaggtgacggtccctgcgggccttgtcctgattggctgggcacgcgtttaatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacaatcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggcccgctgtactttgaatgacaaataacagatttaaa

SEQ ID NO: 19 - protein, 982 aa, Homo sapiens [sequence omitted]

SEQ ID NO: 20 - DNA, 2949 bp, Homo sapiens
atggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatag

SEQ ID NO: 21 - protein, 1131 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFIEHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLQQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 22 - DNA, 4657 bp, Homo sapiens
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcatagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 23 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 24 - DNA, 748 bp, Homo sapiens
gacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgagg

SEQ ID NO: 25 - protein, 351 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 26 - DNA, 1565 bp, Homo sapiens
agtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactaga

SEQ ID NO: 27 - protein, 438 aa, Homo sapiens
MVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 28 - DNA, 3376 bp, Homo sapiens
gagtcttgctgatgctcccggctgaataaaccccttccttctttaacttggtgtctgaggggttttgtctgtggcttgtcctgctacatttcttggttccctgaccaggaagcaaagtgattaacggacagttgaggcagccccttaggcagcttaggcctgccttgtggagcatccccgcggggaactctggccagcttgagcgacacggatcctcagagcgctcccaggtaggcaattgccccagtggaatgcctcgtcagagcagtgcatggcaggcccctgtggaggatcaacgcagtggctgaacacagggaaggaactggcacttggagtccggacaactgaaacttgtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccacctgtcagcttatccagctctggaaggggctctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggcccggcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaaaaaaaaaaaaaaaaaaaaaaaa

SEQ ID NO: 29 - protein, 240 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 30 - DNA, 1284 bp, Homo sapiens
ctctctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttcc

SEQ ID NO: 31 - protein, 364 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 32 - DNA, 1462 bp, Homo sapiens
ctgctcacacaggaagccctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacacca

SEQ ID NO: 33 - protein, 61 aa, Homo sapiens
MKRFLFLLLTISLLVMVQIQTGLSGQNDTSQTSSPSASSNISGGIFLFFVANAIIHLFCFS

SEQ ID NO: 34 - DNA, 467 bp, Homo sapiens
agacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcaacataagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgca

SEQ ID NO: 35 - protein, 378 aa, Homo sapiens
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 36 - DNA, 1541 bp, Homo sapiens
cttcggtttctcttcggggaaagctgctttcagcgcacacgggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctgatcgccctgccctgtctcctgcaaacgaaggaagatccaaacccaccaatcacgaacctaaggatgaaagcaaaggctcagcagttgacctgggaccttaacagaaatgtgaccgatatcgagtgtgttaaagacgccgactattctatgccggcagtgaacaatagctattgccagtttggagcaatttccttatgtgaagtgaccaactacaccgtccgagtggccaacccaccattctccacgtggatcctcttccctgagaacagtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgatttttttttttttaaccca

SEQ ID NO: 37 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 38 - DNA, 5872 bp, Homo sapiens
gcagaagcctgaagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatgataggtatgaagtacagtgagaaaattaacacctgtgagctcattgtcctaccacagcactagagtgggggccgccaaactcccatggccaaacctggtgcaccatttgcctttgtttgtctgttggtttgcttgagacagtcttgctctgttgcccaggctggaatggagtggctattcacaggcacaatcatagcacactttagccttaaactcctgggctcaagtgatccacccgcctcagtctcccaagtagctgggattacaggtgcaaacctggcatgcctgccattgtttggcttatgatctaaggatagctttttaaattttattcattttatttttttttgagacagtgtctcactctgtctcccaggctggagtacagtggtacaatcttggatcaccgcctcccagtttcaagtgatctccctgcctcagcctcctaagtagctgggactacaggtatgtgccaccacgcctggctaatttttatatttttagtagagacggggtttcaccatgttgtccaggctggtctcaaactcctgacctcaggtgatctgcccacctctgcctcccaaagtgctgggattacaggcatgagccaccatgcctggccatttcttacacttttgtatgacatgcctattgcaagcttgcgtgcctctgtcccatgttattttactctgggatttaggtggagggagcagcttctatttggaacattggccatcgcatggcaaatgggtatctgtcacttctgctcctatttagttggttctactataacctttagagcaaatcctgcagccaagccaggcatcaatagggcagaaaagtatattctgtaaataggggtgaggagaagatatttctgaacaatagtctactgcagtaccaaattgcttttcaaagtggctgttctaatgtactcccgtcagtcatataagtgtcatgtaagtatcccattgatccacatccttgctaccctctggtactatcaggtgcccttaattttgccaagccagtgggtatagaatgagatctcactgtggtcttagtttgcatttgcttggttactgatgagcaccttgtcaaatatttatataccatttgtgtttatttttttaaataaaatgcttgctcatgcttttttgcccatttgcaaaaaaacttggggccgggtgcagtggctcatgcctgtagtcccagctctttgggaggccaaggtgggcagatcgcttgagcccaggagttcgagaccagccttggcaacatggcgaaaccctgtctttacaaaaaatacaaaaattagccgggtgtggtggtgtgcacctgaagtcccagctactcagtaggttcgctttgagcctgggaggcagaggttgcagtgagctgggaccgcatcactacacttcagcctgggcaacagagaaaaaccttttctcagaaacaaacaaacccaaatgtggttgtttgtcctgattcctaaaaggtctttatgtattctagataataatctttggtcagttatatgtgttaaaaaatatcttctttgtggccaggcacggtagctcacacctgtaatcccagcactttgcggggctgaggtgggtggatcatctgaggtcaagagttcaagatcagcctggccaacacagtgaaaccccatctctactaaacatgtacaaaacttagctgggtatggtggcgggtgcctgtaaccccagctgctccagaggctgtggcagaagaatcgcttgaacccaggaggcagaggttgcagcgagccaagattgtgccattgcactccagactgggtgacaagagtgaaattctgcctatctatctatctatctatctatatctatatatatatatatatatatcctttgtaatttatttttccctttttaaaattttttataaaattcttttttatttttatttttagcagaggtgaggtttctgaggtttcattatgttgcccaggctggtcttgaactcctgagctcaagtgatcctcccacctcagccttccaaagtgctggaattgcagacatgagccaccgcgcccctcctgtttttctctaattaatggtgtctttctttgtctttctggtaataagcaaaaagttcttcatttgatttggttaaatttataactgttttctcatatggttaacattttttcttgcctggctaaagaaatccttttctgcccaatactataaagaggtttgcccacattttattccaaaagttttaagttttgtctttcatcttgaagtctaatgtatcaggaactggcttttgtgcctgttgggaggtagtgatccaattccatgtcttgcatgtaggtaaccactggtccctgcgccatgtattcaatacgtcgtctttctcctgcgggtctgcaatctcacctaccatccatcaagtttccatagggccatgggtctgcttctgggctccctgttctgttccattgtcaatttgtctatcctgtgccagtatcacactgtgtttattacaatagctttgtaacagctctcgatatccggtaggacatctccctccaccttctttttctacttcagaagtgtcttagctaggtcaggcacggtggctcacgcctgtaatcccagcactttgggaggccgacgcggatggatcacctgaggtcaggagttttgagacagcctggccaacatggtgaaaccccatctctactaaaaaatacaaaaattagtcaggcatggtggcatgtgcctgtaatcccagctatttgggaggctgaggccggagaattgcttgaacccggggggcggaggttgcagtgagccgagatcgtaccattgcactccagcctgggtgacagagcgaaactctgtctcaggaaaaaaaagaaaagagatgtcttggttattcttggttctttattattcaatataaattttagaagctgaatttgaaaagatttggattggaatttcattaaatctacaggtcaatttagggagagttgataattttacagaattgagtcatctggtgttccaataagaataagagaacaattattggctgtacaattcttgccaaatagtaggcaaagcaaagcttaggaagtatactggtgccatttcaggaacaaagctaggtgcgaatatttttgtctttctgaatcatgatgctgtaagttctaaagtgatttctcctcttggctttggacacatggtgtttaattacctactgctgactatccacaaacagaaagagactggtcatgccccacagggttggggtatccaagataatggagcgaggctctcatgtgtcctaggttacacaccgaaaatccacagtttattctgtgaagaaaggaggctatgtttatgatacagactgtgatatttttatcatagcctattctggtatcatgtgcaaaagctataaatgaaaaacacaggaacttggcatgtgagtcattgctccccctaaatgacaattaataaggaaggaacattgagacagaataaaatgatccccttctgggtttaatttagaaagttccataattaggtttaatagaaataaatgtaaatttctatgattaaaaataaattagcacatttagggatacacaaattataaatcattttctaaatgctaaaaacaagctcaggtttttttcagaagaaagttttaattttttttctttagtggaagatatcactctgacggaaagttttgatgtgaggggcggatgactataaagtgggcatcttcccccacaggaagatgtttccatctgtgggtgagaggtgcccaccgcagctagggcaggttacatgtgccctgtgtgtggtaggacttggagagtgatctttatcaacgtttttatttaaaagactatctaataaaacacaaaactatgatgttcacaggaaaaaaagaataagaaaaaaaga

SEQ ID NO: 39 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 40 - DNA, 1600 bp, Homo sapiens
aaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctactctgctttttttctactgttttaatttatactggcatgctaaagccttcctattttgcataataaatgcttcagtgaaaatgca

SEQ ID NO: 41 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 42 - DNA, 766 bp, Petromyzon marinus
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 43 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 44 - DNA, 10681 bp, Homo sapiens
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 45 - protein, 335 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 46 - DNA, 3696 bp, Homo sapiens
ctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtatttctggttttctcttttttggtaggggcttgctttttggttttgtcttccttttctctaactgatgctaaatataacttgtctttaatgcttcttggatcccttagaaggtacttcctttttaaccttaacccttttagtagttaaataattatttccataggttgctattgccaagaagacctcttccaaacagcacatgattattcgtcaaacagtttcgtattccagatactggaatgtggataagaaagtatacatttcaaggggtaggttttattattaagaaagccaaatgaggattttgaaatattctttcctgcatattatccattctagctacatgctggccagtgggccacctttcttttctgcaatttaatgctagtaatatattctatttaacccatgagtcccaaagtattagcatttcaacatgtaagcatgtcggtaagatagttgtgctttgcttagggttccctcctgtgttatggtctggaaagtgtctttaggcagaaagtctgagtgatcacagggttcactcattaatttctcttttctgagccatcatagtctgtgctgtctgctctccagttttctatttctagacagaagtagggcaagttaggtactagttattcttcatggccagaagtgcaagttctactttgcaagacaagattaagttagagaacaccctattccactttggtgaactcagagcaagaactttgagttcctttgggaggaagacagtggagaagtctttgtacttggtgatgtggtttttttcctcatggcttcacctagtggccccaagcatgacttctcccatgtcaatgagcacagccacattcccgagttgaggtgaccccacggtccagaatcatcctcattctggtgaacctggttctctttgtggtgggcatactgggtaggagaatcacccaaaggtcacccatgagctgcagaaaaaaaggctatttgcagaaggagctcacagatcacattgaaagcattgcatattcaaacatcttggtcttctttattggcatgcccacagggtcttctgacctctgattagatcagacactttttagatattgaatcatcagtttctgtacaactatctgaataaggtatataatcaatgaaatttagaatttttttctatgcttactcctgattggtaatttgtttgggtttagaattctatacaaggccatttgtaattttcctcagcactttaaaaatattaaaccatgttttcttaa

SEQ ID NO: 47 - DNA, 306 bp, Artificial Sequence
  Description of Artificial Sequence: Synthetic polynucleotide
tgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 48 - protein, 102 aa, Artificial Sequence
  Description of Artificial Sequence: Synthetic polypeptide
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 49 - DNA, 108 bp, Artificial Sequence
  Description of Artificial Sequence: Synthetic polynucleotide
atgatcaagatagctacaaggaagtatcttggcaaacaaaacgtttatgatattggagtcgaaagagatcacaactttgctctgaagaacggattcatagcttctaat

SEQ ID NO: 50 - protein, 36 aa, Artificial Sequence
  Description of Artificial Sequence: Synthetic polypeptide
MIKIATRKYLGKQNVYDIGVERDHNFALKNGFIASN

SEQ ID NO: 51 - DNA, 303 bp, Artificial Sequence
  Description of Artificial Sequence: Synthetic polynucleotide
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 52 - protein, 101 aa, Artificial Sequence
  Description of Artificial Sequence: Synthetic polypeptide
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 53 - DNA, 159 bp, Artificial Sequence
  Description of Artificial Sequence: Synthetic polynucleotide
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 54 - protein, 53 aa, Artificial Sequence
  Description of Artificial Sequence: Synthetic polypeptide
MKRTADGSEFESPKKKRKVKIISRKSLGTQNVYDIGVEKDHNFLLKNGLVASN

SEQ ID NO: 55 - protein, 20 aa, Artificial Sequence
  Description of Artificial Sequence: Synthetic peptide
METDTLLLWVLLLWVPGSTG

SEQ ID NO: 56 - protein, 16 aa, Artificial Sequence
  Description of Artificial Sequence: Synthetic peptide
SGSETPGTSESATPES

SEQ ID NO: 57 - protein, 4 aa, Artificial Sequence
  Description of Artificial Sequence: Synthetic peptide
SGGS

SEQ ID NO: 58 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 59 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 60 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 61 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 62 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 63 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 64 - protein, 60 aa, Artificial Sequence
  Description of Artificial Sequence: Synthetic polypeptide
  MISC_FEATURE (1)..(60): This sequence may encompass 1-30 "Xaa Pro" repeating units
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
XPXPXPXPXPXPXPXPXPXPXPXPXPXPXPXPXPXPXPXPXPXPXPXPXPXPXPXPXPXP

SEQ ID NO: 65 - protein, 5 aa, Artificial Sequence
  Description of Artificial Sequence: Synthetic peptide
PAPAP

SEQ ID NO: 66 - protein, 6 aa, Artificial Sequence
  Description of Artificial Sequence: Synthetic peptide
PAPAPA

SEQ ID NO: 67 - protein, 7 aa, Artificial Sequence
  Description of Artificial Sequence: Synthetic peptide
PAPAPAP

SEQ ID NO: 68 - protein, 8 aa, Artificial Sequence
  Description of Artificial Sequence: Synthetic peptide
PAPAPAPA

SEQ ID NO: 69 - protein, 9 aa, Artificial Sequence
  Description of Artificial Sequence: Synthetic peptide
PAPAPAPAP

SEQ ID NO: 70 - protein, 15 aa, Artificial Sequence
  Description of Artificial Sequence: Synthetic peptide
PAPAPAPAPAPAPAP

SEQ ID NO: 71 - protein, 21 aa, Artificial Sequence
  Description of Artificial Sequence: Synthetic peptide
PAPAPAPAPAPAPAPAPAPAP

SEQ ID NO: 72 - protein, 24 aa, Artificial Sequence
  Description of Artificial Sequence: Synthetic peptide
SGGSSGSETPGTSESATPESSGGS

SEQ ID NO: 73 - protein, 32 aa, Artificial Sequence
  Description of Artificial Sequence: Synthetic polypeptide
SGGSSGGSSGSETPGTSESATPESSGGSSGGS

SEQ ID NO: 74 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 75 - protein, 24 aa, Artificial Sequence
  Description of Artificial Sequence: Synthetic peptide
SGGSSGGSSGSETPGTSESATPES

SEQ ID NO: 76 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 77 - protein, 60 aa, Artificial Sequence
  Description of Artificial Sequence: Synthetic polypeptide
SGGSSGGSSGSETPGTSESATPESSGGSSGGSSGGSSGGSSGSETPGTSESATPESSGGS

SEQ ID NO: 78 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 79 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 80 - DNA, 1976 bp, Homo sapiens
agagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcatccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaa

SEQ ID NO: 81 - protein, 716 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANGNAIFLTVSREHERVGCFF

SEQ ID NO: 82 - DNA, 2978 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtaaaaaaaaaaaaaa

SEQ ID NO: 83 - protein, 29 aa, Unknown
  Description of Unknown: nuclear localization sequence
PKKKRKVEGADKRTADGSEFESPKKKRKV

SEQ ID NO: 84 - protein, 18 aa, Unknown
  Description of Unknown: nuclear localization sequence
KRTADGSEFESPKKKRKV

SEQ ID NO: 85 - protein, 16 aa, Unknown
  Description of Unknown: nuclear localization sequence
KRPAATKKAGQAKKKK

SEQ ID NO: 86 - protein, 17 aa, Unknown
  Description of Unknown: nuclear localization sequence
KKTELQTTNAENKTKKL

SEQ ID NO: 87 - protein, 19 aa, Unknown
  Description of Unknown: nuclear localization sequence
KRGINDRNFWRGENGRKTR

SEQ ID NO: 88 - protein, 16 aa, Unknown
  Description of Unknown: nuclear localization sequence
RKSGKIAAIVVKRPRK

SEQ ID NO: 89 - protein, 7 aa, Unknown
  Description of Unknown: nuclear localization sequence
PKKKRKV

SEQ ID NO: 90 - protein, 30 aa, Unknown
  Description of Unknown: nuclear localization sequence
MDSLLMNRRKFLYQFKNVRWAKGRRETYLC

SEQ ID NO: 91 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 92 - DNA, 867 bp, Homo sapiens
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctga

SEQ ID NO: 93 - protein, 140 aa, Homo sapiens
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 94 - DNA, 5651 bp, Homo sapiens
catgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaaggacgccagaaagctgttgatcggcttcaagcaggggagggacacctaatttgcttttcttttttttttttttttttttttttttttttgagatggagttttgctcttgttgcccaggctggagtgcaatggtgcatcttggctcactgcaacctccgcctcccaggttcaagtgattctcctgcctcagcctcccgagtagctgagattacaggcacccgccaccatgcctggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccatctctgactttccattctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcgtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattaaccaggtgtggtgctgcacacctgtagtcccagctacttaagaggctgagatgggaggatcgcttgagccctggaatgttgaggctacaatgagctgtgattgcgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgtgtatctgggcgtgttgtatgtcctgctgccgatgccttcattaaaatgatttggaagagcaga

SEQ ID NO: 95 - DNA, 1508 bp, Homo sapiens
ttttgaaacccttcaaaggcagagacttgtccagcctaacctgcctgctgctcctagctcctgaggctcagggcccttggcttctgtccgctctgctcagggccctccagcgtggccactgctcagccatgctcctgctgctcgtcccagtgctcgaggtgatttttaccctgggaggaaccagagcccagtcggtgacccagcttggcagccacgtctctgtctctgaaggagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagtgatctcgaaccgaacagcagtgcttccaagataatctttggatcagggaccagactcagcatccggccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcctacccccaaggaggtgaaagctgctaccacctctgtgcccccccggtaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctggagaatgttgtgaggggtttatttttttttaatagtgttcataaagaaatacatagtattcttcttctcaagacgtggggggaaattatctcattatcgaggccctgctatgctgtgtgtctgggcgtgttgtatgtcctgctgccgatgccttcattaaaatgatttggaa

SEQ ID NO: 96 - protein, 176 aa, Homo sapiens
DLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 97 - DNA, 1151 bp, Homo sapiens
ctggtctagaatattccacatctgctctcactctgccatggactcctggaccttctgctgtgtgtccctttgcatcctggtagcgaagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttctcgacctgttcggctaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggttcaatacacattcttcttttgccagcgcttctgaagagctgctctcacctctctgcatcccaatagatatccccctatgtgcatgcacacctgcacactcacggctgaaatctccctaacccagggggac

SEQ ID NO: 98 - protein, 178 aa, Homo sapiens
DLKNVFPPKVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 99 - DNA, 1489 bp, Homo sapiens
aggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcggacaagactagatccagaagaaagccagagtggacaaggtgggatgatcaaggttcacagggtcagcaaagcacggtgtgcacttcccccaccaagaagcatagaggctgaatggagcacctcaagctcattcttccttcagatcctgacaccttagagctaagctttcaagtctccctgaggaccagccatacagctcagcatctgagtggtgtgcatcccattctcttctggggtcctggtttcctaagatcatagtgaccacttcgctggcactggagcagcatgagggagacagaaccagggctatcaaaggaggctgactttgtactatctgatatgcatgtgtttgtggcctgtgagtctgtgatgtaaggctcaatgtccttacaaagcagcattctctcatccatttttcttcccctgttttctttcagactgtggcttcacctccggtaagtgagtctctcctttttctctctatctttcgccgtctctgctctcgaaccagggcatggagaatccacggacacaggggcgtgagggaggccagagccacctgtgcacaggtgcctacatgctctgttcttgtcaacagagtcttaccagcaaggggtcctgtctgccaccatcctctatgagatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctag

SEQ ID NO: 100 - protein, 2002 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 101 - DNA, 10178 bp, Homo sapiens
ccgtgccatcccaacctcccacctcgcccccaaccttcgcgcttgctctgcttcttctcccaggggtggagacccgccgaggtccccggggttcccgagggctgcacccttccccgcgctcgccagccctggcccctactccgcgctggtccgggcgcaccactccccccgcgccactgcacggcgtgagggcagcccaggtctccactgcgcgccccgctgtacggccccaggtgccgccggcctttgtgctggacgcccggtgcggggggctaattccctgggagccggggctgagggccccagggcggcggcgcaggccggggcggagcgggaggaggccggggcggagcaggaggaggcccgggcggaggaggagagccggcggtagcggcagtggcagcggcgagagcttgggcggccgccgccgcctcctcgcgagcgccgcgcgcccgggtcccgctcgcatgcaagtcacgtccgccccctcggcgcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcaaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgaagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaagtgttgtcttcct

SEQ ID NO: 102 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 103 - DNA, 2090 bp, Homo sapiens
gttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggcccctcctggctggcgagcgggcgccacatctggcccgcacatctgcgctgccggcccggcgcggggtccggagagggcgcggcgcggagcgcagccaggggtccgggaaggcgccgtccgtgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgctgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttatggggcaggctgggcatgtccaaagaggctgcccctctcaccaaa

SEQ ID NO: 104 - protein, 244 aa, Homo sapiens
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 105 - DNA, 831 bp, Homo sapiens
cgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctgg

SEQ ID NO: 106 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 107 - protein, 619 aa, Homo sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 108 - DNA, 2468 bp, Homo sapiens
gcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacaccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgaaaaaaaaaaaaaaaaaaaaaaaaaaaaaaaaaaaaaaaaaaaaaaaaaaaaaaaaaaaaaaa

SEQ ID NO: 109 - protein, 5 aa, Artificial Sequence
  Description of Artificial Sequence: Synthetic peptide
GGGGS

SEQ ID NO: 110 - protein, 15 aa, Artificial Sequence
  Description of Artificial Sequence: Synthetic peptide
GGGGSGGGGSGGGGS

SEQ ID NO: 111 - protein, 493 aa, Artificial Sequence
  Description of Artificial Sequence: Synthetic polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 112 - protein, 494 aa, Artificial Sequence
  Description of Artificial Sequence: Synthetic polypeptide
  MOD_RES (494)..(494): Any amino acid
MEFGLSWLFLVAILKGVQCIDAMGNIQLVQSGPELKKPGETVKISCKASGYTFTNYGMNWVKQAPGKGLRWMGWINTHTGEPTYADDFKGRFAFSLETSASTAYLQINNLKNEDTATYFCTRRGYDWYFDVWGAGTTVTVSSGGGGSGGGGSGGGGSDIKMTQSPSSMYASLGERVTITCKASQDINSYLSWFHHKPGKSPKTLIYRANRLVDGVPSRFSGSGSGQDYSLTISSLDYEDMGIYYCQQYDESPWTFGGGTKLEMKGSGDPATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRX

SEQ ID NO: 113 - protein, 488 aa, Artificial Sequence
  Description of Artificial Sequence: Synthetic polypeptide
MALPVTALLLPLALLLHAARPGSDIELTQSPAIMSASLGEEITLTCSASSSVSYMHWYQQKSGTSPKLLIYSTSNLASGVPSRFSGSGSGTFYSLTISSVEAEDAADYYCHQWSSYTFGGGTKLEIKRGGGGSGGGGSGGGGSQVKLQESGGGLVKPGGSLKLSCAASGFTFSSYAMSWVRQTPEKRLEWVATISSGGSYTYYPDSVKGRFTISRDNAKNTLYLQMSSLRSEDTAMYYCARQDGYYPGWFANWGQGTTVTVSSAAATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 114 - protein, 50 aa, Artificial Sequence
  Description of Artificial Sequence: Synthetic polypeptide
  MISC_FEATURE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 115 - protein, 72 aa, Artificial Sequence
  Description of Artificial Sequence: Synthetic polypeptide
SDPTTTPAPRPPTPAPTIASQPLSLRPEACRPAAGGAVHTRGLDFACDIYIWAPLAGTCGVLLLSLVITLYC

SEQ ID NO: 116 - protein, 112 aa, Artificial Sequence
  Description of Artificial Sequence: Synthetic polypeptide
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 117 - protein, 37 aa, Artificial Sequence
  Description of Artificial Sequence: Synthetic polypeptide
RRDQRLPPDAHKPPGGGSFRTPIQEEQADAHSTLAKI

SEQ ID NO: 118 - protein, 40 aa, Artificial Sequence
  Description of Artificial Sequence: Synthetic polypeptide
SKRSRLLHSDYMNMTPRRPGPTRKHYQPYAPPRDFAAYRS

SEQ ID NO: 119 - protein, 42 aa, Artificial Sequence
  Description of Artificial Sequence: Synthetic polypeptide
KRGRKKLLYIFKQPFMRPVQTTQEEDGCSCRFPEEEEGGCEL

SEQ ID NO: 120 - protein, 47 aa, Artificial Sequence
  Description of Artificial Sequence: Synthetic polypeptide
RFSVVKRGRKKLLYIFKQPFMRPVQTTQEEDGCSCRFPEEEEGGCEL

SEQ ID NO: 121 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacagagucucucagcugguacac

SEQ ID NO: 122 - RNA, 119 nt, Artificial Sequence
  Description of Artificial Sequence: Synthetic polynucleotide
guucugucuuuuggucaggacaaccgucuagcuauaagugcugcagggugugaggaaacuccuauugcuggacgaugucucuuacgaggcauuagcacaccgauuuugauucucaaaca

SEQ ID NO: 123 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacucaaacaaaugugcacaaag

SEQ ID NO: 124 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacucaaacaaaugugucacaaag

SEQ ID NO: 125 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacuuugagaaucaaaaucggua

SEQ ID NO: 126 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacugauguguauaucacagacaa

SEQ ID NO: 127 - RNA, 116 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcaguugcuccaggccacagcau

SEQ ID NO: 128 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacuuccagaagacaccuucuucc

SEQ ID NO: 129 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcaccagaagacaccuucuucccca

SEQ ID NO: 130 - RNA, 117 nt, Artificial Sequence
  Description of Artificial Sequence: Synthetic polynucleotide
guucugucuuuuggucaggacaaccgucuagcuauaagugcugcagggugugagagaaacuccuauugcuggacgaugucucuuacgaggcauuagcacgguuccgaauccuccuga

SEQ ID NO: 131 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacggaacccaaucacugacaggu

SEQ ID NO: 132 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcacagagtctctcagctggtaca

SEQ ID NO: 133 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcacaccgattttgattctcaaac

SEQ ID NO: 134 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcactgattctcaaacaaatgtgt

SEQ ID NO: 135 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcactcaaacaaatgtgtcacaaa

SEQ ID NO: 136 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcacgtttgagaatcaaaatcggt

SEQ ID NO: 137 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcactgatgtgtatatcacagaca

SEQ ID NO: 138 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcacgttgctccaggccacagcac

SEQ ID NO: 139 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcacttccagaagacaccttcttc

SEQ ID NO: 140 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcaccagaagacaccttcttcccc

SEQ ID NO: 141 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcacggttccgaatcctcctcctg

SEQ ID NO: 142 - DNA, 117 bp, Artificial Sequence
  Description of Artificial Sequence: Synthetic polynucleotide
gttctgtcttttggtcaggacaaccgtctagctataagtgctgcagggtgtgagaaactcctattgctggacgatgtctcttacgaggcattagcacggaacccaatcactgacagg

SEQ ID NO: 143 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcacagagtctctcagctggtaca

SEQ ID NO: 144 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcacaccgattttgattctcaaac

SEQ ID NO: 145 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcactgattctcaaacaaatgtgt

SEQ ID NO: 146 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcactcaaacaaatgtgtcacaaa

SEQ ID NO: 147 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcacgtttgagaatcaaaatcggt

SEQ ID NO: 148 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcactgatgtgtatatcacagaca

SEQ ID NO: 149 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcacgttgctccaggccacagcac

SEQ ID NO: 150 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcacttccagaagacaccttcttc

SEQ ID NO: 151 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcaccagaagacaccttcttcccc

SEQ ID NO: 152 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcacggttccgaatcctcctcctg

SEQ ID NO: 153 - DNA, 108 bp, Artificial Sequence
  Description of Artificial Sequence: Synthetic polynucleotide
gacctatagggtcaatgaatctgtgcgtgtgccataagtaattaaaaattacccaccacaggagcacctgaaaacaggtgcttggcacggaacccaatcactgacagg

SEQ ID NO: 154 - DNA, 20 bp, Unknown
  Description of Unknown: target sequence
ctcgatgcgaggactctcca

SEQ ID NO: 155 - DNA, 20 bp, Unknown
  Description of Unknown: target sequence
tctcgatgcgaggactctcc

SEQ ID NO: 156 - DNA, 20 bp, Unknown
  Description of Unknown: target sequence
catcgagataacctcgtgct

SEQ ID NO: 157 - DNA, 20 bp, Unknown
  Description of Unknown: target sequence
tggccgggctcaggcacgag

SEQ ID NO: 158 - DNA, 20 bp, Unknown
  Description of Unknown: target sequence
gcccactggtaggggtgctg

SEQ ID NO: 159 - DNA, 20 bp, Unknown
  Description of Unknown: target sequence
tgggctcggtggtgggactt

SEQ ID NO: 160 - DNA, 20 bp, Unknown
  Description of Unknown: target sequence
cgagcccactacgagacgga

SEQ ID NO: 161 - DNA, 20 bp, Unknown
  Description of Unknown: target sequence
ctcgtagtgggctcggtggt

SEQ ID NO: 162 - DNA, 20 bp, Unknown
  Description of Unknown: target sequence
gccgtgaaggcgtcggccgg

SEQ ID NO: 163 - DNA, 20 bp, Unknown
  Description of Unknown: target sequence
gtttctgagtttcaggattc

SEQ ID NO: 164 - DNA, 20 bp, Unknown
  Description of Unknown: target sequence
catcgggaggaagaacacac

SEQ ID NO: 165 - DNA, 20 bp, Unknown
  Description of Unknown: target sequence
ggaggaagaacacacgggta

SEQ ID NO: 166 - DNA, 20 bp, Unknown
  Description of Unknown: target sequence
gagcgctgggctgcatcaga

SEQ ID NO: 167 - DNA, 20 bp, Unknown
  Description of Unknown: target sequence
tgatctcgatccgagggctc

SEQ ID NO: 168 - DNA, 20 bp, Unknown
  Description of Unknown: target sequence
acggagtgatctcgatccga

SEQ ID NO: 169 - DNA, 20 bp, Unknown
  Description of Unknown: target sequence
gcggaggcattcgtgcgccg

SEQ ID NO: 170 - DNA, 20 bp, Unknown
  Description of Unknown: target sequence
gccgcgctcagaaacttctg

SEQ ID NO: 171 - DNA, 20 bp, Unknown
  Description of Unknown: target sequence
gggcctcgggcctgagccct

SEQ ID NO: 172 - DNA, 20 bp, Unknown
  Description of Unknown: target sequence
cctcgggctggcggccaccc

SEQ ID NO: 173 - DNA, 20 bp, Unknown
  Description of Unknown: target sequence
ccactcgcccgtgccccgtc

SEQ ID NO: 174 - DNA, 20 bp, Unknown
  Description of Unknown: target sequence
gcattcgtgcgccgaggcct

SEQ ID NO: 175 - DNA, 20 bp, Unknown
  Description of Unknown: target sequence
gagcctcaccccagcgctcc

SEQ ID NO: 176 - DNA, 20 bp, Unknown
  Description of Unknown: target sequence
gaggggctccgggagcgctg

SEQ ID NO: 177 - DNA, 20 bp, Unknown
  Description of Unknown: target sequence
agggctggtcttccacatct

SEQ ID NO: 178 - DNA, 20 bp, Unknown
  Description of Unknown: target sequence
gcggggagcccaggccaaag

SEQ ID NO: 179 - DNA, 20 bp, Unknown
  Description of Unknown: target sequence
gccaccatgaagaccttttg

SEQ ID NO: 180 - DNA, 20 bp, Unknown
  Description of Unknown: target sequence
ttgcggcacacctgagtacc

SEQ ID NO: 181 - DNA, 20 bp, Unknown
  Description of Unknown: target sequence
gtaggagaactgggggaagt

SEQ ID NO: 182 - DNA, 20 bp, Unknown
  Description of Unknown: target sequence
ctcctactcggccagcggca

SEQ ID NO: 183 - DNA, 20 bp, Unknown
  Description of Unknown: target sequence
gaaaaccttctgtgggaccc

SEQ ID NO: 184 - DNA, 20 bp, Unknown
  Description of Unknown: target sequence
agtaggagaactgggggaag

SEQ ID NO: 185 - DNA, 20 bp, Unknown
  Description of Unknown: target sequence
gttgcaagtctgacatttga

SEQ ID NO: 186 - DNA, 20 bp, Unknown
  Description of Unknown: target sequence
gaaacactacctggtacaca

SEQ ID NO: 187 - DNA, 20 bp, Unknown
  Description of Unknown: target sequence
tgtggcagacctacagtgta

SEQ ID NO: 188 - DNA, 20 bp, Unknown
  Description of Unknown: target sequence
gggcacaccttgcattggta

SEQ ID NO: 189 - DNA, 20 bp, Unknown
  Description of Unknown: target sequence
ctgcgcacctggcattcatg

SEQ ID NO: 190 - DNA, 20 bp, Unknown
  Description of Unknown: target sequence
cctaccggtccgcaagcgtc

SEQ ID NO: 191 - DNA, 20 bp, Unknown
  Description of Unknown: target sequence
actcacacatctggataggt

SEQ ID NO: 192 - DNA, 20 bp, Unknown
  Description of Unknown: target sequence
gacttacctagaccttcctg

SEQ ID NO: 193 - DNA, 20 bp, Unknown
  Description of Unknown: target sequence
aatcttacagagctgaaaag

SEQ ID NO: 194 - DNA, 20 bp, Unknown
  Description of Unknown: target sequence
catcatattcttcacttcca

SEQ ID NO: 195 - DNA, 20 bp, Unknown
  Description of Unknown: target sequence
aagaatatgatgttcctccc

SEQ ID NO: 196 - DNA, 20 bp, Unknown
  Description of Unknown: target sequence
cccctaaaccacgaccgcgc

SEQ ID NO: 197 - DNA, 20 bp, Unknown
  Description of Unknown: target sequence
tcctgcgcggtcgtggttta

SEQ ID NO: 198 - DNA, 20 bp, Unknown
  Description of Unknown: target sequence
ccctactctgtgaccaactg

SEQ ID NO: 199 - DNA, 20 bp, Unknown
  Description of Unknown: target sequence
cgcaggcgcgtcttccaggt

SEQ ID NO: 200 - DNA, 20 bp, Unknown
  Description of Unknown: target sequence
gcaccgcaggcgcgtcttcc

SEQ ID NO: 201 - DNA, 20 bp, Unknown
  Description of Unknown: target sequence
gaacaagagcaatgactttg

SEQ ID NO: 202 - DNA, 20 bp, Unknown
  Description of Unknown: target sequence
cacctacctaagaaccatcc

SEQ ID NO: 203 - DNA, 20 bp, Unknown
  Description of Unknown: target sequence
ggggttccagggcctgtctg

SEQ ID NO: 204 - DNA, 20 bp, Unknown
  Description of Unknown: target sequence
gacttgcacaacatgcagaa

SEQ ID NO: 205 - DNA, 20 bp, Unknown
  Description of Unknown: target sequence
ttgccagaagcaagatccca

SEQ ID NO: 206 - DNA, 20 bp, Unknown
  Description of Unknown: target sequence
ccatgaacaaccaaaagaga

SEQ ID NO: 207 - DNA, 20 bp, Unknown
  Description of Unknown: target sequence
tcacccccatccagaagccg

SEQ ID NO: 208 - DNA, 20 bp, Unknown
  Description of Unknown: target sequence
atctggctggtctcgtccag

SEQ ID NO: 209 - DNA, 20 bp, Unknown
  Description of Unknown: target sequence
gatgagcgacctcccggtga

SEQ ID NO: 210 - DNA, 20 bp, Unknown
  Description of Unknown: target sequence
agacagcgatgacgtctctg

SEQ ID NO: 211 - DNA, 20 bp, Unknown
  Description of Unknown: target sequence
acgtctctgaggtggacgcg

SEQ ID NO: 212 - DNA, 20 bp, Unknown
  Description of Unknown: target sequence
ttaggggagagtttctcggc

SEQ ID NO: 213 - DNA, 20 bp, Unknown
  Description of Unknown: target sequence
ggagagtgaggaggaggaag

SEQ ID NO: 214 - DNA, 20 bp, Unknown
  Description of Unknown: target sequence
aaggctccgaatccgaatct

SEQ ID NO: 215 - DNA, 20 bp, Unknown
  Description of Unknown: target sequence
atcgtcactcacgaccggct

SEQ ID NO: 216 - DNA, 20 bp, Unknown
  Description of Unknown: target sequence
tgacagtgaggaggaacaag

SEQ ID NO: 217 - DNA, 20 bp, Unknown
  Description of Unknown: target sequence
cacccgtggttgttacactc

SEQ ID NO: 218 - DNA, 20 bp, Unknown
  Description of Unknown: target sequence
catcagccaggccccgcagg

SEQ ID NO: 219 - DNA, 20 bp, Unknown
  Description of Unknown: target sequence
ggtgtatccatctgagttga

SEQ ID NO: 220 - DNA, 20 bp, Unknown
  Description of Unknown: target sequence
gggtgtatccatctgagttg

SEQ ID NO: 221 - DNA, 20 bp, Unknown
  Description of Unknown: target sequence
gcgcaagaagcagatcgacg

SEQ ID NO: 222 - DNA, 20 bp, Unknown
  Description of Unknown: target sequence
ttactacagcctggccagca

SEQ ID NO: 223 - protein, 1368 aa, Streptococcus pyogenes [sequence omitted]

SEQ ID NO: 224 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 225 - RNA, 125 nt, Artificial Sequence
  Description of Artificial Sequence: Synthetic polynucleotide
guuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 226 - RNA, 76 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugc

SEQ ID NO: 227 - RNA, 84 nt, Artificial Sequence
  Description of Artificial Sequence: Synthetic oligonucleotide
guuuuaguacucuguaaugaaaauuacagaaucuacuaaaacaaggcaaaaugccguguuuaucucgucaacuuguuggcgaga

SEQ ID NO: 228 - DNA, 97 bp, Artificial Sequence
  Description of Artificial Sequence: Synthetic oligonucleotide
  Description of Combined DNA/RNA Molecule: Synthetic oligonucleotide
guucugtcuuuuggucaggacaaccgucuagcuauaagugcugcagggugugagaaacuccuauugcuggacgaugucucuuacgaggcauuagcac

SEQ ID NO: 229 - RNA, 88 nt, Artificial Sequence
  Description of Artificial Sequence: Synthetic oligonucleotide
gaccuauagggucaaugaaucugugcgugugccauaaguaauuaaaaauuacccaccacaggagcaccugaaaacaggugcuuggcac

SEQ ID NO: 230 - RNA, 80 nt, Artificial Sequence
  Description of Artificial Sequence: Synthetic oligonucleotide
guuuuagagcuagaaauagcaaguuaaaauaaggcuaguccguuaucaacuugaaaaagugggaccgagucggugcuuuu

SEQ ID NO: 231 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 232 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 233 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 234 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 235 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 236 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 237 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 238 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 239 - protein, 987 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDFAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 240 - protein, 1210 aa, Unknown
  Description of Unknown: uncultured Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 241 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 242 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 243 - DNA, 117 bp, Artificial Sequence
  Description of Artificial Sequence: Synthetic oligonucleotide
  Description of Combined DNA/RNA Molecule: Synthetic oligonucleotide
  modified_base (98)..(117): a, c, t, g, unknown or other
guucugtcuuuuggucaggacaaccgucuagcuauaagugcugcagggugugagaaacuccuauugcuggacgaugucucuuacgaggcauuagcacnnnnnnnnnnnnnnnnnnnn

SEQ ID NO: 244 - RNA, 108 nt, Artificial Sequence
  Description of Artificial Sequence: Synthetic polynucleotide
  modified_base (89)..(108): a, c, u, g, unknown or other
gaccuauagggucaaugaaucugugcgugugccauaaguaauuaaaaauuacccaccacaggagcaccugaaaacaggugcuuggcacnnnnnnnnnnnnnnnnnnnn

SEQ ID NO: 245 - RNA, 119 nt, Artificial Sequence
  Description of Artificial Sequence: Synthetic polynucleotide
  modified_base (100)..(119): a, c, u, g, unknown or other
gucuaaaggacagaauuuuucaacgggugugccaauggccacuuuccagguggcaaagcccguugaacuucucaaaaagaacgaucugagaaguggcacnnnnnnnnnnnnnnnnnnnn

SEQ ID NO: 246 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 247 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 248 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 249 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 250 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 251 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 252 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 253 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 254 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 255 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 256 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 257 - protein, 1410 aa, Artificial Sequence
  Description of Artificial Sequence: Synthetic polypeptide
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 258 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 259 - protein, 1129 aa, Alicyclobacillus acidiphilus
MAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDI

SEQ ID NO: 260 - protein, 1140 aa, Bacillus hisashii
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 261 - DNA, 47 bp, Artificial Sequence
  Description of Artificial Sequence: Synthetic oligonucleotide
gggaaataagagagaaaagaagagtaagaagaaatataagagccacc

SEQ ID NO: 262 - DNA, 101 bp, Artificial Sequence
  Description of Artificial Sequence: Synthetic polynucleotide
gctggagcctcggtggccatgcttcttgccccttgggcctccccccagcccctcctccccttcctgcacccgtacccccgtggtctttgaataaagtctga

SEQ ID NO: 263 - DNA, 3420 bp, Artificial Sequence
  Description of Artificial Sequence: Synthetic polynucleotide
atggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaag

SEQ ID NO: 264 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 265 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 266 - protein, 1302 aa, Unknown
  Description of Unknown: Cas12c1 sequence
MQTKKTHLHLISAKASRKYRRTIACLSDTAKKDLERRKQSGAADPAQELSCLKTIKFKLEVPEGSKLPSFDRISQIYNALETIEKGSLSYLLFALILSGFRIFPNSSAAKTFASSSCYKNDQFASQIKEIFGEMVKNFIPSELESILKKGRRKNNKDWTEENIKRVLNSEFGRKNSEGSSALFDSFLSKFSQELFRKFDSWNEVNKKYLEAAELLDSMLASYGPFDSVCKMIGDSDSRNSLPDKSTIAFTNNAEITVDIESSVMPYMAIAALLREYRQSKSKAAPVAYVQSHLTTTNGNGLSWFFKFGLDLIRKAPVSSKQSTSDGSKSLQELFSVPDDKLDGLKFIKEACEALPEASLLCGEKGELLGYQDFRTSFAGHIDSWVANYVNRLFELIELVNQLPESIKLPSILTQKNHNLVASLGLQEAEVSHSLELFEGLVKNVRQTLKKLAGIDISSSPNEQDIKEFYAFSDVLNRLGSIRNQIENAVQTAKKDKIDLESAIEWKEWKKLKKLPKLNGLGGGVPKQQELLDKALESVKQIRHYQRIDFERVIQWAVNEHCLETVPKFLVDAEKKKINKESSTDFAAKENAVRFLLEGIGAAARGKTDSVSKAAYNWFVVNNFLAKKDLNRYFINCQGCIYKPPYSKRRSLAFALRSDNKDTIEVVWEKFETFYKEISKEIEKFNIFSQEFQTFLHLENLRMKLLLRRIQKPIPAEIAFFSLPQEYYDSLPPNVAFLALNQEITPSEYITQFNLYSSFLNGNLILLRRSRSYLRAKFSWVGNSKLIYAAKEARLWKIPNAYWKSDEWKMILDSNVLVFDKAGNVLPAPTLKKVCEREGDLRLFYPLLRQLPHDWCYRNPFVKSVGREKNVIEVNKEGEPKVASALPGSLFRLIGPAPFKSLLDDCFFNPLDKDLRECMLIVDQEISQKVEAQKVEASLESCTYSIAVPIRYHLEEPKVSNQFENVLAIDQGEAGLAYAVFSLKSIGEAETKPIAVGTIRIPSIRRLIHSVSTYRKKKQRLQNFKQNYDSTAFIMRENVTGDVCAKIVGLMKEFNAFPVLEYDVKNLESGSRQLSAVYKAVNSHFLYFKEPGRDALRKQLWYGGDSWTIDGIEIVTRERKEDGKEGVEKIVPLKVFPGRSVSARFTSKTCSCCGRNVFDWLFTEKKAKTNKKFNVNSKGELTTADGVIQLFEADRSKGPKFYARRKERTPLTKPIAKGSYSLEEIERRVRTNLRRAPKSKQSRDTSQSQYFCVYKDCALHFSGMQADENAAINIGRRFLTALRKNRRSDFPSNVKISDRLLDN

SEQ ID NO: 267 - protein, 1218 aa, Unknown
  Description of Unknown: Cas12c2 sequence
MTKHSIPLHAFRNSGADARKWKGRIALLAKRGKETMRTLQFPLEMSEPEAAAINTTPFAVAYNAIEGTGKGTLFDYWAKLHLAGFRFFPSGGAATIFRQQAVFEDASWNAAFCQQSGKDWPWLVPSKLYERFTKAPREVAKKDGSKKSIEFTQENVANESHVSLVGASITDKTPEDQKEFFLKMAGALAEKFDSWKSANEDRIVAMKVIDEFLKSEGLHLPSLENIAVKCSVETKPDNATVAWHDAPMSGVQNLAIGVFATCASRIDNIYDLNGGKLSKLIQESATTPNVTALSWLFGKGLEYFRTTDIDTIMQDFNIPASAKESIKPLVESAQAIPTMTVLGKKNYAPFRPNFGGKIDSWIANYASRLMLLNDILEQIEPGFELPQALLDNETLMSGIDMTGDELKELIEAVYAWVDAAKQGLATLLGRGGNVDDAVQTFEQFSAMMDTLNGTLNTISARYVRAVEMAGKDEARLEKLIECKFDIPKWCKSVPKLVGISGGLPKVEEEIKVMNAAFKDVRARMFVRFEEIAAYVASKGAGMDVYDALEKRELEQIKKLKSAVPERAHIQAYRAVLHRIGRAVQNCSEKTKQLFSSKVIEMGVFKNPSHLNNFIFNQKGAIYRSPFDRSRHAPYQLHADKLLKNDWLELLAEISATLMASESTEQMEDALRLERTRLQLQLSGLPDWEYPASLAKPDIEVEIQTALKMQLAKDTVTSDVLQRAFNLYSSVLSGLTFKLLRRSFSLKMRFSVADTTQLIYVPKVCDWAIPKQYLQAEGEIGIAARVVTESSPAKMVTEVEMKEPKALGHFMQQAPHDWYFDASLGGTQVAGRIVEKGKEVGKERKLVGYRMRGNSAYKTVLDKSLVGNTELSQCSMIIEIPYTQTVDADFRAQVQAGLPKVSINLPVKETITASNKDEQMLFDRFVAIDLGERGLGYAVFDAKTLELQESGHRPIKAITNLLNRTHHYEQRPNQRQKFQAKFNVNLSELRENTVGDVCHQINRICAYYNAFPVLEYMVPDRLDKQLKSVYESVTNRYIWSSTDAHKSARVQFWLGGETWEHPYLKSAKDKKPLVLSPGRGASGKGTSQTCSCCGRNPFDLIKDMKPRAKIAVVDGKAKLENSELKLFERNLESKDDMLARRHRNERAGMEQPLTPGNYTVDEIKALLRANLRRAPKNRRTKDTTVSEYHCVFSDCGKTMHADENAAVNIGGKFIADIEK

SEQ ID NO: 268 - protein, 1252 aa, Unknown
  Description of Unknown: OspCas12c sequence
MTKLRHRQKKLTHDWAGSKKREVLGSNGKLQNPLLMPVKKGQVTEFRKAFSAYARATKGEMTDGRKNMFTHSFEPFKTKPSLHQCELADKAYQSLHSYLPGSLAHFLLSAHALGFRIFSKSGEATAFQASSKIEAYESKLASELACVDLSIQNLTISTLFNALTTSVRGKGEETSADPLIARFYTLLTGKPLSRDTQGPERDLAEVISRKIASSFGTWKEMTANPLQSLQFFEEELHALDANVSLSPAFDVLIKMNDLQGDLKNRTIVFDPDAPVFEYNAEDPADIIIKLTARYAKEAVIKNQNVGNYVKNAITTTNANGLGWLLNKGLSLLPVSTDDELLEFIGVERSHPSCHALIELIAQLEAPELFEKNVFSDTRSEVQGMIDSAVSNHIARLSSSRNSLSMDSEELERLIKSFQIHTPHCSLFIGAQSLSQQLESLPEALQSGVNSADILLGSTQYMLTNSLVEESIATYQRTLNRINYLSGVAGQINGAIKRKAIDGEKIHLPAAWSELISLPFIGQPVIDVESDLAHLKNQYQTLSNEFDTLISALQKNFDLNFNKALLNRTQHFEAMCRSTKKNALSKPEIVSYRDLLARLTSCLYRGSLVLRRAGIEVLKKHKIFESNSELREHVHERKHFVFVSPLDRKAKKLLRLTDSRPDLLHVIDEILQHDNLENKDRESLWLVRSGYLLAGLPDQLSSSFINLPIITQKGDRRLIDLIQYDQINRDAFVMLVTSAFKSNLSGLQYRANKQSFVVTRTLSPYLGSKLVYVPKDKDWLVPSQMFEGRFADILQSDYMVWKDAGRLCVIDTAKHLSNIKKSVFSSEEVLAFLRELPHRTFIQTEVRGLGVNVDGIAFNNGDIPSLKTFSNCVQVKVSRTNTSLVQTLNRWFEGGKVSPPSIQFERAYYKKDDQIHEDAAKRKIRFQMPATELVHASDDAGWTPSYLLGIDPGEYGMGLSLVSINNGEVLDSGFIHINSLINFASKKSNHQTKVVPRQQYKSPYANYLEQSKDSAAGDIAHILDRLIYKLNALPVFEALSGNSQSAADQVWTKVLSFYTWGDNDAQNSIRKQHWFGASHWDIKGMLRQPPTEKKPKPYIAFPGSQVSSYGNSQRCSCCGRNPIEQLREMAKDTSIKELKIRNSEIQLFDGTIKLFNPDPSTVIERRRHNLGPSRIPVADRTFKNISPSSLEFKELITIVSRSIRHSPEFIAKKRGIGSEYFCAYSDCNSSLNSEANAAANVAQKFQKQLFFEL

SEQ ID NO: 269 - protein, 767 aa, Unknown
  Description of Unknown: Cas12g1 sequence
MAQASSTPAVSPRPRPRYREERTLVRKLLPRPGQSKQEFRENVKKLRKAFLQFNADVSGVCQWAIQFRPRYGKPAEPTETFWKFFLEPETSLPPNDSRSPEFRRLQAFEAAAGINGAAALDDPAFTNELRDSILAVASRPKTKEAQRLFSRLKDYQPAHRMILAKVAAEWIESRYRRAHQNWERNYEEWKKEKQEWEQNHPELTPEIREAFNQIFQQLEVKEKRVRICPAARLLQNKDNCQYAGKNKHSVLCNQFNEFKKNHLQGKAIKFFYKDAEKYLRCGLQSLKPNVQGPFREDWNKYLRYMNLKEETLRGKNGGRLPHCKNLGQECEFNPHTALCKQYQQQLSSRPDLVQHDELYRKWRREYWREPRKPVFRYPSVKRHSIAKIFGENYFQADFKNSVVGLRLDSMPAGQYLEFAFAPWPRNYRPQPGETEISSVHLHFVGTRPRIGFRFRVPHKRSRFDCTQEELDELRSRTFPRKAQDQKFLEAARKRLLETFPGNAEQELRLLAVDLGTDSARAAFFIGKTFQQAFPLKIVKIEKLYEQWPNQKQAGDRRDASSKQPRPGLSRDHVGRHLQKMRAQASEIAQKRQELTGTPAPETTTDQAAKKATLQPFDLRGLTVHTARMIRDWARLNARQIIQLAEENQVDLIVLESLRGFRPPGYENLDQEKKRRVAFFAHGRIRRKVTEKAVERGMRVVTVPYLASSKVCAECRKKQKDNKQWEKNKKRGLFKCEGCGSQAQVDENAARVLGRVFWGEIELPTAIP

SEQ ID NO: 270 - protein, 870 aa, Unknown
  Description of Unknown: Cas12h1 sequence
MKVHEIPRSQLLKIKQYEGSFVEWYRDLQEDRKKFASLLFRWAAFGYAAREDDGATYISPSQALLERRLLLGDAEDVAIKFLDVLFKGGAPSSSCYSLFYEDFALRDKAKYSGAKREFIEGLATMPLDKIIERIRQDEQLSKIPAEEWLILGAEYSPEEIWEQVAPRIVNVDRSLGKQLRERLGIKCRRPHDAGYCKILMEVVARQLRSHNETYHEYLNQTHEMKTKVANNLTNEFDLVCEFAEVLEEKNYGLGWYVLWQGVKQALKEQKKPTKIQIAVDQLRQPKFAGLLTAKWRALKGAYDTWKLKKRLEKRKAFPYMPNWDNDYQIPVGLTGLGVFTLEVKRTEVVVDLKEHGKLFCSHSHYFGDLTAEKHPSRYHLKFRHKLKLRKRDSRVEPTIGPWIEAALREITIQKKPNGVFYLGLPYALSHGIDNFQIAKRFFSAAKPDKEVINGLPSEMVVGAADLNLSNIVAPVKARIGKGLEGPLHALDYGYGELIDGPKILTPDGPRCGELISLKRDIVEIKSAIKEFKACQREGLTMSEETTTWLSEVESPSDSPRCMIQSRIADTSRRLNSFKYQMNKEGYQDLAEALRLLDAMDSYNSLLESYQRMHLSPGEQSPKEAKFDTKRASFRDLLRRRVAHTIVEYFDDCDIVFFEDLDGPSDSDSRNNALVKLLSPRTLLLYIRQALEKRGIGMVEVAKDGTSQNNPISGHVGWRNKQNKSEIYFYEDKELLVMDADEVGAMNILCRGLNHSVCPYSFVTKAPEKKNDEKKEGDYGKRVKRFLKDRYGSSNVRFLVASMGFVTVTTKRPKDALVGKRLYYHGGELVTHDLHNRMKDEIKYLVEKEVLARRVSLSDSTIKSYKSFAHV

SEQ ID NO: 271 - protein, 1093 aa, Unknown
  Description of Unknown: Cas12i1 sequence
MSNKEKNASETRKAYTTKMIPRSHDRMKLLGNFMDYLMDGTPIFFELWNQFGGGIDRDIISGTANKDKISDDLLLAVNWFKVMPINSKPQGVSPSNLANLFQQYSGSEPDIQAQEYFASNFDTEKHQWKDMRVEYERLLAELQLSRSDMHHDLKLMYKEKCIGLSLSTAHYITSVMFGTGAKNNRQTKHQFYSKVIQLLEESTQINSVEQLASIILKAGDCDSYRKLRIRCSRKGATPSILKIVQDYELGTNHDDEVNVPSLIANLKEKLGRFEYECEWKCMEKIKAFLASKVGPYYLGSYSAMLENALSPIKGMTTKNCKFVLKQIDAKNDIKYENEPFGKIVEGFFDSPYFESDTNVKWVLHPHHIGESNIKTLWEDLNAIHSKYEEDIASLSEDKKEKRIKVYQGDVCQTINTYCEEVGKEAKTPLVQLLRYLYSRKDDIAVDKIIDGITFLSKKHKVEKQKINPVIQKYPSFNFGNNSKLLGKIISPKDKLKHNLKCNRNQVDNYIWIEIKVLNTKTMRWEKHHYALSSTRFLEEVYYPATSENPPDALAARFRTKTNGYEGKPALSAEQIEQIRSAPVGLRKVKKRQMRLEAARQQNLLPRYTWGKDFNINICKRGNNFEVTLATKVKKKKEKNYKVVLGYDANIVRKNTYAAIEAHANGDGVIDYNDLPVKPIESGFVTVESQVRDKSYDQLSYNGVKLLYCKPHVESRRSFLEKYRNGTMKDNRGNNIQIDFMKDFEAIADDETSLYYFNMKYCKLLQSSIRNHSSQAKEYREEIFELLRDGKLSVLKLSSLSNLSFVMFKVAKSLIGTYFGHLLKKPKNSKSDVKAPPITDEDKQKADPEMFALRLALEEKRLNKVKSKKEVIANKIVAKALELRDKYGPVLIKGENISDTTKKGKKSSTNSFLMDWLARGVANKVKEMVMMHQGLEFVEVNPNFTSHQDPFVHKNPENTFRARYSRCTPSELTEKNRKEILSFLSDKPSKRPTNAYYNEGAMAFLATYGLKKNDVLGVSLEKFKQIMANILHQRSEDQLLFPSRGGMFYLATYKLDADATSVNWNGKQFWVCNADLVAAYNVGLVDIQKDFKKK

SEQ ID NO: 272 - protein, 1054 aa, Unknown
  Description of Unknown: Cas12i2 sequence
MSSAIKSYKSVLRPNERKNQLLKSTIQCLEDGSAFFFKMLQGLFGGITPEIVRFSTEQEKQQQDIALWCAVNWFRPVSQDSLTHTIASDNLVEKFEEYYGGTASDAIKQYFSASIGESYYWNDCRQQYYDLCRELGVEVSDLTHDLEILCREKCLAVATESNQNNSIISVLFGTGEKEDRSVKLRITKKILEAISNLKEIPKNVAPIQEIILNVAKATKETFRQVYAGNLGAPSTLEKFIAKDGQKEFDLKKLQTDLKKVIRGKSKERDWCCQEELRSYVEQNTIQYDLWAWGEMFNKAHTALKIKSTRNYNFAKQRLEQFKEIQSLNNLLVVKKLNDFFDSEFFSGEETYTICVHHLGGKDLSKLYKAWEDDPADPENAIVVLCDDLKNNFKKEPIRNILRYIFTIRQECSAQDILAAAKYNQQLDRYKSQKANPSVLGNQGFTWTNAVILPEKAQRNDRPNSLDLRIWLYLKLRHPDGRWKKHHIPFYDTRFFQEIYAAGNSPVDTCQFRTPRFGYHLPKLTDQTAIRVNKKHVKAAKTEARIRLAIQQGTLPVSNLKITEISATINSKGQVRIPVKFDVGRQKGTLQIGDRFCGYDQNQTASHAYSLWEVVKEGQYHKELGCFVRFISSGDIVSITENRGNQFDQLSYEGLAYPQYADWRKKASKFVSLWQITKKNKKKEIVTVEAKEKFDAICKYQPRLYKFNKEYAYLLRDIVRGKSLVELQQIRQEIFRFIEQDCGVTRLGSLSLSTLETVKAVKGIIYSYFSTALNASKNNPISDEQRKEFDPELFALLEKLELIRTRKKKQKVERIANSLIQTCLENNIKFIRGEGDLSTTNNATKKKANSRSMDWLARGVFNKIRQLAPMHNITLFGCGSLYTSHQDPLVHRNPDKAMKCRWAAIPVKDIGDWVLRKLSQNLRAKNIGTGEYYHQGVKEFLSHYELQDLEEELLKWRSDRKSNIPCWVLQNRLAEKLGNKEAVVYIPVRGGRIYFATHKVATGAVSIVFDQKQVWVCNADHVAAANIALTVKGIGEQSSDEENPDGSRIKLQLTS

SEQ ID NO: 273 - protein, 6 aa, Artificial Sequence
  Description of Artificial Sequence: Synthetic peptide
GGSGGS

SEQ ID NO: 274 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatcccggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 275 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 276 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaaggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcgaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 277 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 278 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 279 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 280 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 281 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 282 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 283 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 284 - protein, 7 aa, Artificial Sequence
  Description of Artificial Sequence: Synthetic peptide
GGGSGGS

SEQ ID NO: 285 - protein, 707 aa, Unknown
  Description of Unknown: Cas-phi-1 sequence
MADTPTLFTQFLRHHLPGQRFRKDILKQAGRILANKGEDATIAFLRGKSEESPPDFQPPVKCPIIACSRPLTEWPIYQASVAIQGYVYGQSLAEFEASDPGCSKDGLLGWFDKTGVCTDYFSVQGLNLIFQNARKRYIGVQTKVTNRNEKRHKKLKRINAKRIAEGLPELTSDEPESALDETGHLIDPPGLNTNIYCYQQVSPKPLALSEVNQLPTAYAGYSTSGDDPIQPMVTKDRLSISKGQPGYIPEHQRALLSQKKHRRMRGYGLKARALLVIVRIQDDWAVIDLRSLLRNAYWRRIVQTKEPSTITKLLKLVTGDPVLDATRMVATFTYKPGIVQVRSAKCLKNKQGSKLFSERYLNETVSVTSIDLGSNNLVAVATYRLVNGNTPELLQRFTLPSHLVKDFERYKQAHDTLEDSIQKTAVASLPQGQQTEIRMWSMYGFREAQERVCQELGLADGSIPWNVMTATSTILTDLFLARGGDPKKCMFTSEPKKKKNSKQVLYKIRDRAWAKMYRTLLSKETREAWNKALWGLKRGSPDYARLSKRKEELARRCVNYTISTAEKRAQCGRTIVALEDLNIGFFHGRGKQEPGWVGLFTRKKENRWLMQALHKAFLELAHHRGYHVIEVNPAYTSQTCPVCRHCDPDNRDQHNREAFHCIGCGFRGNADLDVATHNIAMVAITGESLKRARGSVASKTPQPLAAE

SEQ ID NO: 286 - protein, 757 aa, Unknown
  Description of Unknown: Cas-phi-2 sequence
MPKPAVESEFSKVLKKHFPGERFRSSYMKRGGKILAAQGEEAVVAYLQGKSEEEPPNFQPPAKCHVVTKSRDFAEWPIMKASEAIQRYIYALSTTERAACKPGKSSESHAAWFAATGVSNHGYSHVQGLNLIFDHTLGRYDGVLKKVQLRNEKARARLESINASRADEGLPEIKAEEEEVATNETGHLLQPPGINPSFYVYQTISPQAYRPRDEIVLPPEYAGYVRDPNAPIPLGVVRNRCDIQKGCPGYIPEWQREAGTAISPKTGKAVTVPGLSPKKNKRMRRYWRSEKEKAQDALLVTVRIGTDWVVIDVRGLLRNARWRTIAPKDISLNALLDLFTGDPVIDVRRNIVTFTYTLDACGTYARKWTLKGKQTKATLDKLTATQTVALVAIDLGQTNPISAGISRVTQENGALQCEPLDRFTLPDDLLKDISAYRIAWDRNEEELRARSVEALPEAQQAEVRALDGVSKETARTQLCADFGLDPKRLPWDKMSSNTTFISEALLSNSVSRDQVFFTPAPKKGAKKKAPVEVMRKDRTWARAYKPRLSVEAQKLKNEALWALKRTSPEYLKLSRRKEELCRRSINYVIEKTRRRTQCQIVIPVIEDLNVRFFHGSGKRLPGWDNFFTAKKENRWFIQGLHKAFSDLRTHRSFYVFEVRPERTSITCPKCGHCEVGNRDGEAFQCLSCGKTCNADLDVATHNLTQVALTGKTMPKREEPRDAQGTAPARKTKKASKSKAPPAEREDQTPAQEPSQTS

SEQ ID NO: 287 - protein, 766 aa, Unknown
  Description of Unknown: Cas-phi-3 sequence
MEKEITELTKIRREFPNKKFSSTDMKKAGKLLKAEGPDAVRDFLNSCQEIIGDFKPPVKTNIVSISRPFEEWPVSMVGRAIQEYYFSLTKEELESVHPGTSSEDHKSFFNITGLSNYNYTSVQGLNLIFKNAKAIYDGTLVKANNKNKKLEKKFNEINHKRSLEGLPIITPDFEEPFDENGHLNNPPGINRNIYGYQGCAAKVFVPSKHKMVSLPKEYEGYNRDPNLSLAGFRNRLEIPEGEPGHVPWFQRMDIPEGQIGHVNKIQRFNFVHGKNSGKVKFSDKTGRVKRYHHSKYKDATKPYKFLEESKKVSALDSILAIITIGDDWVVFDIRGLYRNVFYRELAQKGLTAVQLLDLFTGDPVIDPKKGVVTFSYKEGVVPVFSQKIVPRFKSRDTLEKLTSQGPVALLSVDLGQNEPVAARVCSLKNINDKITLDNSCRISFLDDYKKQIKDYRDSLDELEIKIRLEAINSLETNQQVEIRDLDVFSADRAKANTVDMFDIDPNLISWDSMSDARVSTQISDLYLKNGGDESRVYFEINNKRIKRSDYNISQLVRPKLSDSTRKNLNDSIWKLKRTSEEYLKLSKRKLELSRAVVNYTIRQSKLLSGINDIVIILEDLDVKKKFNGRGIRDIGWDNFFSSRKENRWFIPAFHKAFSELSSNRGLCVIEVNPAWTSATCPDCGFCSKENRDGINFTCRKCGVSYHADIDVATLNIARVAVLGKPMSGPADRERLGDTKKPRVARSRKTMKRKDISNSTVEAMVTA

SEQ ID NO: 288 - protein, 765 aa, Unknown
  Description of Unknown: Cas-phi-4 sequence
MYSLEMADLKSEPSLLAKLLRDRFPGKYWLPKYWKLAEKKRLTGGEEAACEYMADKQLDSPPPNFRPPARCVILAKSRPFEDWPVHRVASKAQSFVIGLSEQGFAALRAAPPSTADARRDWLRSHGASEDDLMALEAQLLETIMGNAISLHGGVLKKIDNANVKAAKRLSGRNEARLNKGLQELPPEQEGSAYGADGLLVNPPGLNLNIYCRKSCCPKPVKNTARFVGHYPGYLRDSDSILISGTMDRLTIIEGMPGHIPAWQREQGLVKPGGRRRRLSGSESNMRQKVDPSTGPRRSTRSGTVNRSNQRTGRNGDPLLVEIRMKEDWVLLDARGLLRNLRWRESKRGLSCDHEDLSLSGLLALFSGDPVIDPVRNEVVFLYGEGIIPVRSTKPVGTRQSKKLLERQASMGPLTLISCDLGQTNLIAGRASAISLTHGSLGVRSSVRIELDPEIIKSFERLRKDADRLETEILTAAKETLSDEQRGEVNSHEKDSPQTAKASLCRELGLHPPSLPWGQMGPSTTFIADMLISHGRDDDAFLSHGEFPTLEKRKKFDKRFCLESRPLLSSETRKALNESLWEVKRTSSEYARLSQRKKEMARRAVNFVVEISRRKTGLSNVIVNIEDLNVRIFHGGGKQAPGWDGFFRPKSENRWFIQAIHKAFSDLAAHHGIPVIESDPQRTSMTCPECGHCDSKNRNGVRFLCKGCGASMDADFDAACRNLERVALTGKPMPKPSTSCERLLSATTGKVCSDHSLSHDAIEKAS

SEQ ID NO: 289 - protein, 793 aa, Unknown
  Description of Unknown: Cas-phi-5 sequence
MSSLPTPLELLKQKHADLFKGLQFSSKDNKMAGKVLKKDGEEAALAFLSERGVSRGELPNFRPPAKTLVVAQSRPFEEFPIYRVSEAIQLYVYSLSVKELETVPSGSSTKKEHQRFFQDSSVPDFGYTSVQGLNKIFGLARGIYLGVITRGENQLQKAKSKHEALNKKRRASGEAETEFDPTPYEYMTPERKLAKPPGVNHSIMCYVDISVDEFDFRNPDGIVLPSEYAGYCREINTAIEKGTVDRLGHLKGGPGYIPGHQRKESTTEGPKINFRKGRIRRSYTALYAKRDSRRVRQGKLALPSYRHHMMRLNSNAESAILAVIFFGKDWVVFDLRGLLRNVRWRNLFVDGSTPSTLLGMFGDPVIDPKRGVVAFCYKEQIVPVVSKSITKMVKAPELLNKLYLKSEDPLVLVAIDLGQTNPVGVGVYRVMNASLDYEVVTRFALESELLREIESYRQRTNAFEAQIRAETFDAMTSEEQEEITRVRAFSASKAKENVCHRFGMPVDAVDWATMGSNTIHIAKWVMRHGDPSLVEVLEYRKDNEIKLDKNGVPKKVKLTDKRIANLTSIRLRFSQETSKHYNDTMWELRRKHPVYQKLSKSKADFSRRVVNSIIRRVNHLVPRARIVFIIEDLKNLGKVFHGSGKRELGWDSYFEPKSENRWFIQVLHKAFSETGKHKGYYIIECWPNWTSCTCPKCSCCDSENRHGEVFRCLACGYTCNTDFGTAPDNLVKIATTGKGLPGPKKRCKGSSKGKNPKIARSSETGVSVTESGAPKVKKSSPTQTSQSSSQSAP

SEQ ID NO: 290 - protein, 441 aa, Unknown
  Description of Unknown: Cas-phi-6 sequence
MNKIEKEKTPLAKLMNENFAGLRFPFAIIKQAGKKLLKEGELKTIEYMTGKGSIEPLPNFKPPVKCLIVAKRRDLKYFPICKASCEIQSYVYSLNYKDFMDYFSTPMTSQKQHEEFFKKSGLNIEYQNVAGLNLIFNNVKNTYNGVILKVKNRNEKLKKKAIKNNYEFEEIKTFNDDGCLINKPGINNVIYCFQSISPKILKNITHLPKEYNDYDCSVDRNIIQKYVSRLDIPESQPGHVPEWQRKLPEFNNTNNPRRRRKWYSNGRNISKGYSVDQVNQAKIEDSLLAQIKIGEDWIILDIRGLLRDLNRRELISYKNKLTIKDVLGFFSDYPIIDIKKNLVTFCYKEGVIQVVSQKSIGNKKSKQLLEKLIENKPIALVSIDLGQTNPVSVKISKLNKINNKISIESFTYRFLNEEILKEIEKYRKDYDKLELKLINEA

SEQ ID NO: 291 - protein, 772 aa, Unknown
  Description of Unknown: Cas-phi-7 sequence
MSNTAVSTREHMSNKTTPPSPLSLLLRAHFPGLKFESQDYKIAGKKLRDGGPEAVISYLTGKGQAKLKDVKPPAKAFVIAQSRPFIEWDLVRVSRQIQEKIFGIPATKGRPKQDGLSETAFNEAVASLEVDGKSKLNEETRAAFYEVLGLDAPSLHAQAQNALIKSAISIREGVLKKVENRNEKNLSKTKRRKEAGEEATFVEEKAHDERGYLIHPPGVNQTIPGYQAVVIKSCPSDFIGLPSGCLAKESAEALTDYLPHDRMTIPKGQPGYVPEWQHPLLNRRKNRRRRDWYSASLNKPKATCSKRSGTPNRKNSRTDQIQSGRFKGAIPVLMRFQDEWVIIDIRGLLRNARYRKLLKEKSTIPDLLSLFTGDPSIDMRQGVCTFIYKAGQACSAKMVKTKNAPEILSELTKSGPVVLVSIDLGQTNPIAAKVSRVTQLSDGQLSHETLLRELLSNDSSDGKEIARYRVASDRLRDKLANLAVERLSPEHKSEILRAKNDTPALCKARVCAALGLNPEMIAWDKMTPYTEFLATAYLEKGGDRKVATLKPKNRPEMLRRDIKFKGTEGVRIEVSPEAAEAYREAQWDLQRTSPEYLRLSTWKQELTKRILNQLRHKAAKSSQCEVVVMAFEDLNIKMMHGNGKWADGGWDAFFIKKRENRWFMQAFHKSLTELGAHKGVPTIEVTPHRTSITCTKCGHCDKANRDGERFACQKCGFVAHADLEIATDNIERVALTGKPMPKPESERSGDAKKSVGARKAAFKPEEDAEAAE

SEQ ID NO: 292 - protein, 717 aa, Unknown
  Description of Unknown: Cas-phi-8 sequence
MIKPTVSQFLTPGFKLIRNHSRTAGLKLKNEGEEACKKFVRENEIPKDECPNFQGGPAIANIIAKSREFTEWEIYQSSLAIQEVIFTLPKDKLPEPILKEEWRAQWLSEHGLDTVPYKEAAGLNLIIKNAVNTYKGVQVKVDNKNKNNLAKINRKNEIAKLNGEQEISFEEIKAFDDKGYLLQKPSPNKSIYCYQSVSPKPFITSKYHNVNLPEEYIGYYRKSNEPIVSPYQFDRLRIPIGEPGYVPKWQYTFLSKKENKRRKLSKRIKNVSPILGIICIKKDWCVFDMRGLLRTNHWKKYHKPTDSINDLFDYFTGDPVIDTKANVVRFRYKMENGIVNYKPVREKKGKELLENICDQNGSCKLATVDVGQNNPVAIGLFELKKVNGELTKTLISRHPTPIDFCNKITAYRERYDKLESSIKLDAIKQLTSEQKIEVDNYNNNFTPQNTKQIVCSKLNINPNDLPWDKMISGTHFISEKAQVSNKSEIYFTSTDKGKTKDVMKSDYKWFQDYKPKLSKEVRDALSDIEWRLRRESLEFNKLSKSREQDARQLANWISSMCDVIGIENLVKKNNFFGGSGKREPGWDNFYKPKKENRWWINAIHKALTELSQNKGKRVILLPAMRTSITCPKCKYCDSKNRNGEKFNCLKCGIELNADIDVATENLATVAITAQSMPKPTCERSGDAKKPVRARKAKAPEFHDKLAPSYTVVLREAV

SEQ ID NO: 293 - protein, 793 aa, Unknown
  Description of Unknown: Cas-phi-9 sequence
MRSSREIGDKILMRQPAEKTAFQVFRQEVIGTQKLSGGDAKTAGRLYKQGKMEAAREWLLKGARDDVPPNFQPPAKCLVVAVSHPFEEWDISKTNHDVQAYIYAQPLQAEGHLNGLSEKWEDTSADQHKLWFEKTGVPDRGLPVQAINKIAKAAVNRAFGVVRKVENRNEKRRSRDNRIAEHNRENGLTEVVREAPEVATNADGFLLHPPGIDPSILSYASVSPVPYNSSKHSFVRLPEEYQAYNVEPDAPIPQFVVEDRFAIPPGQPGYVPEWQRLKCSTNKHRRMRQWSNQDYKPKAGRRAKPLEFQAHLTRERAKGALLVVMRIKEDWVVFDVRGLLRNVEWRKVLSEEAREKLTLKGLLDLFTGDPVIDTKRGIVTFLYKAEITKILSKRTVKTKNARDLLLRLTEPGEDGLRREVGLVAVDLGQTHPIAAAIYRIGRTSAGALESTVLHRQGLREDQKEKLKEYRKRHTALDSRLRKEAFETLSVEQQKEIVTVSGSGAQITKDKVCNYLGVDPSTLPWEKMGSYTHFISDDFLRRGGDPNIVHFDRQPKKGKVSKKSQRIKRSDSQWVGRMRPRLSQETAKARMEADWAAQNENEEYKRLARSKQELARWCVNTLLQNTRCITQCDEIVVVIEDLNVKSLHGKGAREPGWDNFFTPKTENRWFIQILHKTFSELPKHRGEHVIEGCPLRTSITCPACSYCDKNSRNGEKFVCVACGATFHADFEVATYNLVRLATTGMPMPKSLERQGGGEKAGGARKARKKAKQVEKIVVQANANVTMNGASLHSP

SEQ ID NO: 294 - protein, 812 aa, Unknown
  Description of Unknown: Cas-phi-10 sequence
MDMLDTETNYATETPAQQQDYSPKPPKKAQRAPKGFSKKARPEKKPPKPITLFTQKHFSGVRFLKRVIRDASKILKLSESRTITFLEQAIERDGSAPPDVTPPVHNTIMAVTRPFEEWPEVILSKALQKHCYALTKKIKIKTWPKKGPGKKCLAAWSARTKIPLIPGQVQATNGLFDRIGSIYDGVEKKVTNRNANKKLEYDEAIKEGRNPAVPEYETAYNIDGTLINKPGYNPNLYITQSRTPRLITEADRPLVEKILWQMVEKKTQSRNQARRARLEKAAHLQGLPVPKFVPEKVDRSQKIEIRIIDPLDKIEPYMPQDRMAIKASQDGHVPYWQRPFLSKRRNRRVRAGWGKQVSSIQAWLTGALLVIVRLGNEAFLADIRGALRNAQWRKLLKPDATYQSLFNLFTGDPVVNTRTNHLTMAYREGVVNIVKSRSFKGRQTREHLLTLLGQGKTVAGVSFDLGQKHAAGLLAAHFGLGEDGNPVFTPIQACFLPQRYLDSLTNYRNRYDALTLDMRRQSLLALTPAQQQEFADAQRDPGGQAKRACCLKLNLNPDEIRWDLVSGISTMISDLYIERGGDPRDVHQQVETKPKGKRKSEIRILKIRDGKWAYDFRPKIADETRKAQREQLWKLQKASSEFERLSRYKINIARAIANWALQWGRELSGCDIVIPVLEDLNVGSKFFDGKGKWLLGWDNRFTPKKENRWFIKVLHKAVAELAPHRGVPVYEVMPHRTSMTCPACHYCHPTNREGDRFECQSCHVVKNTDRDVAPYNILRVAVEGKTLDRWQAEKKPQAEPDRPMILIDNQES

SEQ ID NO: 295 - DNA, 20 bp, Unknown
  Description of Unknown: target sequence
ccttacctagggacgcagcc

SEQ ID NO: 296 - DNA, 20 bp, Unknown
  Description of Unknown: target sequence
ggatccccagcgccagctgc

SEQ ID NO: 297 - DNA, 20 bp, Unknown
  Description of Unknown: target sequence
agcgccagctgccggcctcc

SEQ ID NO: 298 - DNA, 20 bp, Unknown
  Description of Unknown: target sequence
gcgccagctgccggcctcca

SEQ ID NO: 299 - DNA, 20 bp, Unknown
  Description of Unknown: target sequence
cctggctcagcgccacgggc

SEQ ID NO: 300 - DNA, 20 bp, Unknown
  Description of Unknown: target sequence
gctgcaggtgcagacaggtg

SEQ ID NO: 301 - DNA, 20 bp, Unknown
  Description of Unknown: target sequence
gcggtaccacgtcttgtaga

SEQ ID NO: 302 - DNA, 20 bp, Unknown
  Description of Unknown: target sequence
tgcctgtgggaacaaacaga

SEQ ID NO: 303 - DNA, 20 bp, Unknown
  Description of Unknown: target sequence
cttactttcactatcctggg

SEQ ID NO: 304 - DNA, 20 bp, Unknown
  Description of Unknown: target sequence
tcccttactttcactatcct

SEQ ID NO: 305 - DNA, 20 bp, Unknown
  Description of Unknown: target sequence
ctcccaggatagtgaaagta

SEQ ID NO: 306 - DNA, 20 bp, Unknown
  Description of Unknown: target sequence
tgatgtctgaaagggcagag

SEQ ID NO: 307 - DNA, 20 bp, Unknown
  Description of Unknown: target sequence
tgcccaggagctggtgcgga

SEQ ID NO: 308 - DNA, 20 bp, Unknown
  Description of Unknown: target sequence
ttgctgccacagaaccagaa

SEQ ID NO: 309 - DNA, 20 bp, Unknown
  Description of Unknown: target sequence
attcaagggattgaaaaccc

SEQ ID NO: 310 - DNA, 20 bp, Unknown
  Description of Unknown: target sequence
acctgcccaggggatacccg

SEQ ID NO: 311 - DNA, 20 bp, Unknown
  Description of Unknown: target sequence
cagcggcagccttctgagtc

SEQ ID NO: 312 - DNA, 20 bp, Unknown
  Description of Unknown: target sequence
gctacaaacaagctcatctt

SEQ ID NO: 313 - DNA, 20 bp, Unknown
  Description of Unknown: target sequence
ccagccaagtacgtaagtag

SEQ ID NO: 314 - DNA, 20 bp, Unknown
  Description of Unknown: target sequence
ctggatatctgtgggacaag

SEQ ID NO: 315 - DNA, 20 bp, Unknown
  Description of Unknown: target sequence
cttacctgggctggggaaga

SEQ ID NO: 316 - DNA, 20 bp, Unknown
  Description of Unknown: target sequence
ttcgtatctgtaaaaccaag

SEQ ID NO: 317 - DNA, 20 bp, Unknown
  Description of Unknown: target sequence
tttcaaaacctgtcagtgat

SEQ ID NO: 318 - DNA, 20 bp, Unknown
  Description of Unknown: target sequence
ttcaaaacctgtcagtgatt

SEQ ID NO: 319 - DNA, 20 bp, Unknown
  Description of Unknown: target sequence
ggaccctgcatagagagaga

SEQ ID NO: 320 - DNA, 20 bp, Unknown
  Description of Unknown: target sequence
tgccccagcagacgggcacg

SEQ ID NO: 321 - DNA, 20 bp, Unknown
  Description of Unknown: target sequence
gttacctgggccatgtcccc

SEQ ID NO: 322 - DNA, 20 bp, Unknown
  Description of Unknown: target sequence
cttactgttagatttatatc

SEQ ID NO: 323 - DNA, 20 bp, Unknown
  Description of Unknown: target sequence
ttactgttagatttatatca

SEQ ID NO: 324 - DNA, 20 bp, Unknown
  Description of Unknown: target sequence
tttgctatggaaacacaaac

SEQ ID NO: 325 - DNA, 20 bp, Unknown
  Description of Unknown: target sequence
tccatagcaaatatccacat

SEQ ID NO: 326 - DNA, 20 bp, Unknown
  Description of Unknown: target sequence
gcagcaaccctcacaacctt

SEQ ID NO: 327 - DNA, 20 bp, Unknown
  Description of Unknown: target sequence
cagcaaccctcacaaccttt

SEQ ID NO: 328 - DNA, 20 bp, Unknown
  Description of Unknown: target sequence
aggcaggctcccctcgcctc

SEQ ID NO: 329 - DNA, 20 bp, Unknown
  Description of Unknown: target sequence
ggagcagcaggaccagcttc

SEQ ID NO: 330 - DNA, 20 bp, Unknown
  Description of Unknown: target sequence
caggaatacctgagctttct

SEQ ID NO: 331 - DNA, 20 bp, Unknown
  Description of Unknown: target sequence
aggttccagattccattgct

SEQ ID NO: 332 - DNA, 20 bp, Unknown
  Description of Unknown: target sequence
ctgggcccaggggctgaggc

SEQ ID NO: 333 - DNA, 20 bp, Unknown
  Description of Unknown: target sequence
gatcgagtggccccaggtcc

SEQ ID NO: 334 - DNA, 20 bp, Unknown
  Description of Unknown: target sequence
tcacccgacttctgaacgtg

SEQ ID NO: 335 - DNA, 20 bp, Unknown
  Description of Unknown: target sequence
ttacctgcccactgttagcc

SEQ ID NO: 336 - DNA, 20 bp, Unknown
  Description of Unknown: target sequence
gaagccacaggaagtctgtg

SEQ ID NO: 337 - DNA, 20 bp, Unknown
  Description of Unknown: target sequence
actccagttcctgacggctg

SEQ ID NO: 338 - DNA, 20 bp, Unknown
  Description of Unknown: target sequence
acctacaggagtacctgacg

SEQ ID NO: 339 - DNA, 20 bp, Unknown
  Description of Unknown: target sequence
ttcccagagcaccagagcca

SEQ ID NO: 340 - DNA, 20 bp, Unknown
  Description of Unknown: target sequence
acgttcagaagtcgggtgag

SEQ ID NO: 341 - DNA, 20 bp, Unknown
  Description of Unknown: target sequence
ttcagagcagtttgagacag

SEQ ID NO: 342 - DNA, 20 bp, Unknown
  Description of Unknown: target sequence
cctgctgggaaacagacaac

SEQ ID NO: 343 - DNA, 20 bp, Unknown
  Description of Unknown: target sequence
cactcacagtctagggtggc

SEQ ID NO: 344 - DNA, 20 bp, Unknown
  Description of Unknown: target sequence
caaccggcagcgagggaacg

SEQ ID NO: 345 - DNA, 20 bp, Unknown
  Description of Unknown: target sequence
acagggctggggcaggacag

SEQ ID NO: 346 - DNA, 20 bp, Unknown
  Description of Unknown: target sequence
catccaccagctcgcagcac

SEQ ID NO: 347 - DNA, 20 bp, Unknown
  Description of Unknown: target sequence
atccaccagctcgcagcaca

SEQ ID NO: 348 - DNA, 20 bp, Unknown
  Description of Unknown: target sequence
tccaccagctcgcagcacag

SEQ ID NO: 349 - DNA, 20 bp, Unknown
  Description of Unknown: target sequence
ccaccagctcgcagcacagg

SEQ ID NO: 350 - DNA, 20 bp, Unknown
  Description of Unknown: target sequence
tgtcacctggcaggaggagg

SEQ ID NO: 351 - DNA, 20 bp, Unknown
  Description of Unknown: target sequence
gtcacctggcaggaggaggc

SEQ ID NO: 352 - DNA, 20 bp, Unknown
  Description of Unknown: target sequence
ggcaccctgcagggagaaga

SEQ ID NO: 353 - DNA, 20 bp, Unknown
  Description of Unknown: target sequence
gcaccctgcagggagaagaa

SEQ ID NO: 354 - DNA, 20 bp, Unknown
  Description of Unknown: target sequence
attctgtcgtgggtaggggc

SEQ ID NO: 355 - DNA, 20 bp, Unknown
  Description of Unknown: target sequence
ctccattctgtcgtgggtag

SEQ ID NO: 356 - DNA, 20 bp, Unknown
  Description of Unknown: target sequence
cctcgggctgcaaaggagag

SEQ ID NO: 357 - DNA, 20 bp, Unknown
  Description of Unknown: target sequence
cgggctgcaaaggagagggg

SEQ ID NO: 358 - DNA, 20 bp, Unknown
  Description of Unknown: target sequence
gctgacctttccggtatccc

SEQ ID NO: 359 - DNA, 20 bp, Unknown
  Description of Unknown: target sequence
ctgacctttccggtatccca

SEQ ID NO: 360 - DNA, 20 bp, Unknown
  Description of Unknown: target sequence
tgttgcactgagatggggca

SEQ ID NO: 361 - DNA, 20 bp, Unknown
  Description of Unknown: target sequence
ctgttgcactgagatggggc

SEQ ID NO: 362 - DNA, 20 bp, Unknown
  Description of Unknown: target sequence
gccctgcagcccccagaacc

SEQ ID NO: 363 - DNA, 20 bp, Unknown
  Description of Unknown: target sequence
ctcacccgcagtgacacaca

SEQ ID NO: 364 - DNA, 20 bp, Unknown
  Description of Unknown: target sequence
gcagcacccagggcaggacc

SEQ ID NO: 365 - DNA, 20 bp, Unknown
  Description of Unknown: target sequence
cagcacccagggcaggacca

SEQ ID NO: 366 - DNA, 20 bp, Unknown
  Description of Unknown: target sequence
gtccctgtggaacagcagca

SEQ ID NO: 367 - DNA, 20 bp, Unknown
  Description of Unknown: target sequence
gtgggttcaagttcggatgg

SEQ ID NO: 368 - DNA, 20 bp, Unknown
  Description of Unknown: target sequence
gccccacctgggtctgagct

SEQ ID NO: 369 - DNA, 20 bp, Unknown
  Description of Unknown: target sequence
ggccccacctgggtctgagc

SEQ ID NO: 370 - DNA, 20 bp, Unknown
  Description of Unknown: target sequence
ccacctgggtctgagctggg

SEQ ID NO: 371 - DNA, 20 bp, Unknown
  Description of Unknown: target sequence
aggcctcccaggagccctca

SEQ ID NO: 372 - DNA, 20 bp, Unknown
  Description of Unknown: target sequence
ctcccaggagccctcaggga

SEQ ID NO: 373 - DNA, 20 bp, Unknown
  Description of Unknown: target sequence
cccccagctcacagtcacca

SEQ ID NO: 374 - DNA, 20 bp, Unknown
  Description of Unknown: target sequence
ggtctcaccggtgcttatgt

SEQ ID NO: 375 - DNA, 20 bp, Unknown
  Description of Unknown: target sequence
tgctgcgccgacataagcac

SEQ ID NO: 376 - DNA, 20 bp, Unknown
  Description of Unknown: target sequence
ggcagggctgggagagagca

SEQ ID NO: 377 - DNA, 20 bp, Unknown
  Description of Unknown: target sequence
cgagagcacgagcatgggtg

SEQ ID NO: 378 - DNA, 20 bp, Unknown
  Description of Unknown: target sequence
gagcacgagcatgggtgagg

SEQ ID NO: 379 - DNA, 20 bp, Unknown
  Description of Unknown: target sequence
agcacgagcatgggtgagga

SEQ ID NO: 380 - DNA, 20 bp, Unknown
  Description of Unknown: target sequence
gcacgagcatgggtgaggag

SEQ ID NO: 381 - DNA, 20 bp, Unknown
  Description of Unknown: target sequence
ctcacccatgctcgtgctct

SEQ ID NO: 382 - DNA, 20 bp, Unknown
  Description of Unknown: target sequence
ggtgcctgcgcgggggaagg

SEQ ID NO: 383 - DNA, 20 bp, Unknown
  Description of Unknown: target sequence
gtgcctgcgcgggggaagga

SEQ ID NO: 384 - DNA, 20 bp, Unknown
  Description of Unknown: target sequence
cttggtgcctgcgcggggga

SEQ ID NO: 385 - DNA, 20 bp, Unknown
  Description of Unknown: target sequence
ggccccagggccctgccgcc

SEQ ID NO: 386 - DNA, 20 bp, Unknown
  Description of Unknown: target sequence
tctacgctcaggcaggggag

SEQ ID NO: 387 - DNA, 20 bp, Unknown
  Description of Unknown: target sequence
ccaccaggacggccccccat

SEQ ID NO: 388 - DNA, 20 bp, Unknown
  Description of Unknown: target sequence
aggcccaggcggcagggccc

SEQ ID NO: 389 - DNA, 20 bp, Unknown
  Description of Unknown: target sequence
ggcccaggcggcagggccct

SEQ ID NO: 390 - DNA, 20 bp, Unknown
  Description of Unknown: target sequence
acgactggccagggcgcctg

SEQ ID NO: 391 - DNA, 20 bp, Unknown
  Description of Unknown: target sequence
caccgcccagacgactggcc

SEQ ID NO: 392 - DNA, 20 bp, Unknown
  Description of Unknown: target sequence
ctacaactgggctggcggcc

SEQ ID NO: 393 - DNA, 20 bp, Unknown
  Description of Unknown: target sequence
ggagtctgagagatggagag

SEQ ID NO: 394 - DNA, 20 bp, Unknown
  Description of Unknown: target sequence
cagcaaccagacggacaagc

SEQ ID NO: 395 - DNA, 20 bp, Unknown
  Description of Unknown: target sequence
gtgtcacacaactgcccaac

SEQ ID NO: 396 - DNA, 20 bp, Unknown
  Description of Unknown: target sequence
agccggccagttccaaaccc

SEQ ID NO: 397 - DNA, 20 bp, Unknown
  Description of Unknown: target sequence
cagttccaaaccctggtggt

SEQ ID NO: 398 - DNA, 20 bp, Unknown
  Description of Unknown: target sequence
cggccagttccaaaccctgg

SEQ ID NO: 399 - DNA, 20 bp, Unknown
  Description of Unknown: target sequence
ggacccagactagcagcacc

SEQ ID NO: 400 - DNA, 20 bp, Unknown
  Description of Unknown: target sequence
gacgttacctcgtgcggccc

SEQ ID NO: 401 - DNA, 20 bp, Unknown
  Description of Unknown: target sequence
tccctgcagagaaacacact

SEQ ID NO: 402 - DNA, 20 bp, Unknown
  Description of Unknown: target sequence
gagactcaccaggggctggc

SEQ ID NO: 403 - DNA, 20 bp, Unknown
  Description of Unknown: target sequence
cctccttctttgaggagaaa

SEQ ID NO: 404 - DNA, 20 bp, Unknown
  Description of Unknown: target sequence
ttctctctggaagggcacaa

SEQ ID NO: 405 - DNA, 20 bp, Unknown
  Description of Unknown: target sequence
ccagtggcgagagaagaccc

SEQ ID NO: 406 - DNA, 20 bp, Unknown
  Description of Unknown: target sequence
tgcccagccactgaggcctg

SEQ ID NO: 407 - DNA, 20 bp, Unknown
  Description of Unknown: target sequence
cgactggccagggcgcctgt

SEQ ID NO: 408 - DNA, 20 bp, Unknown
  Description of Unknown: target sequence
accgcccagacgactggcca

SEQ ID NO: 409 - DNA, 20 bp, Unknown
  Description of Unknown: target sequence
gtttctgcagccgctttggg

SEQ ID NO: 410 - DNA, 20 bp, Unknown
  Description of Unknown: target sequence
ttacctggagccacccaaag

SEQ ID NO: 411 - DNA, 20 bp, Unknown
  Description of Unknown: target sequence
tcactaggtgagcaaaagag

SEQ ID NO: 412 - DNA, 20 bp, Unknown
  Description of Unknown: target sequence
gcctctccagccaggggctg

SEQ ID NO: 413 - DNA, 20 bp, Unknown
  Description of Unknown: target sequence
cttggcagcatcagccagac

SEQ ID NO: 414 - DNA, 20 bp, Unknown
  Description of Unknown: target sequence
ccactgggcgggaaagagaa

SEQ ID NO: 415 - DNA, 20 bp, Unknown
  Description of Unknown: target sequence
acatactcgaggcctggccc

SEQ ID NO: 416 - DNA, 20 bp, Unknown
  Description of Unknown: target sequence
cctgcagccccgcgtccagc

SEQ ID NO: 417 - DNA, 20 bp, Unknown
  Description of Unknown: target sequence
cgcgtccagctggatgagcg

SEQ ID NO: 418 - DNA, 20 bp, Unknown
  Description of Unknown: target sequence
tgggccaggcctcgagtatg

SEQ ID NO: 419 - DNA, 20 bp, Unknown
  Description of Unknown: target sequence
gggagttacccagaacagtg

SEQ ID NO: 420 - DNA, 20 bp, Unknown
  Description of Unknown: target sequence
cctgccccaagtcagcccca

SEQ ID NO: 421 - DNA, 20 bp, Unknown
  Description of Unknown: target sequence
gccagggccgagtccctgtc

SEQ ID NO: 422 - DNA, 20 bp, Unknown
  Description of Unknown: target sequence
ccagggccgagtccctgtcc

SEQ ID NO: 423 - DNA, 20 bp, Unknown
  Description of Unknown: target sequence
gccccagggcccagagtcca

SEQ ID NO: 424 - DNA, 20 bp, Unknown
  Description of Unknown: target sequence
atgtgagccaggcccaggct

SEQ ID NO: 425 - DNA, 20 bp, Unknown
  Description of Unknown: target sequence
gaggagtccacttggcagtg

SEQ ID NO: 426 - DNA, 20 bp, Unknown
  Description of Unknown: target sequence
gagtcactgaaaagagtaga

SEQ ID NO: 427 - DNA, 20 bp, Unknown
  Description of Unknown: target sequence
ctggacaagaacgctttgtg

SEQ ID NO: 428 - DNA, 20 bp, Unknown
  Description of Unknown: target sequence
ccatcccagaggagtttctc

SEQ ID NO: 429 - DNA, 20 bp, Unknown
  Description of Unknown: target sequence
tggcaatgccagctgtacca

SEQ ID NO: 430 - DNA, 20 bp, Unknown
  Description of Unknown: target sequence
taccagggggagaggcttct

SEQ ID NO: 431 - DNA, 20 bp, Unknown
  Description of Unknown: target sequence
ggcattgccaaggctgggaa

SEQ ID NO: 432 - DNA, 20 bp, Unknown
  Description of Unknown: target sequence
ggcacctatggagaaagtac

SEQ ID NO: 433 - DNA, 20 bp, Unknown
  Description of Unknown: target sequence
agacaggtgagccagggaca

SEQ ID NO: 434 - DNA, 20 bp, Unknown
  Description of Unknown: target sequence
ggctcacctgtcttctccaa

SEQ ID NO: 435 - DNA, 20 bp, Unknown
  Description of Unknown: target sequence
gtcgccactgtgagaagaga

SEQ ID NO: 436 - DNA, 20 bp, Unknown
  Description of Unknown: target sequence
gcaggctcagagcaagatag

SEQ ID NO: 437 - DNA, 20 bp, Unknown
  Description of Unknown: target sequence
gctggagcaagaaccggagc

SEQ ID NO: 438 - DNA, 20 bp, Unknown
  Description of Unknown: target sequence
actcacctttgcagaagaca

SEQ ID NO: 439 - DNA, 20 bp, Unknown
  Description of Unknown: target sequence
cactcacctttgcagaagac

SEQ ID NO: 440 - DNA, 20 bp, Unknown
  Description of Unknown: target sequence
agggccaggtcctggtagcc

SEQ ID NO: 441 - DNA, 20 bp, Unknown
  Description of Unknown: target sequence
ggcccagcctgctgtggtac

SEQ ID NO: 442 - DNA, 20 bp, Unknown
  Description of Unknown: target sequence
gcttcggcaggctgacagcc

SEQ ID NO: 443 - DNA, 20 bp, Unknown
  Description of Unknown: target sequence
tatccaaggactgagggcca

SEQ ID NO: 444 - DNA, 20 bp, Unknown
  Description of Unknown: target sequence
ggaacccagatttatgtaat

SEQ ID NO: 445 - DNA, 20 bp, Unknown
  Description of Unknown: target sequence
gctcaccaattacataaatc

SEQ ID NO: 446 - DNA, 20 bp, Unknown
  Description of Unknown: target sequence
ctcaccaattacataaatct

SEQ ID NO: 447 - DNA, 20 bp, Unknown
  Description of Unknown: target sequence
ctcagctgaacctggctacc

SEQ ID NO: 448 - DNA, 20 bp, Unknown
  Description of Unknown: target sequence
ggcgtctcaaacaggtatct

SEQ ID NO: 449 - DNA, 20 bp, Unknown
  Description of Unknown: target sequence
caaagcctgaagagaaatcc

SEQ ID NO: 450 - DNA, 20 bp, Unknown
  Description of Unknown: target sequence
agagcctgaaggagaagtct

SEQ ID NO: 451 - DNA, 20 bp, Unknown
  Description of Unknown: target sequence
tcccagtaccgggaaggcga

SEQ ID NO: 452 - DNA, 20 bp, Unknown
  Description of Unknown: target sequence
ggttcctgtggagcacaggg

SEQ ID NO: 453 - DNA, 20 bp, Unknown
  Description of Unknown: target sequence
tggggttcctgtggagcaca

SEQ ID NO: 454 - DNA, 20 bp, Unknown
  Description of Unknown: target sequence
tcatttcctagatgggagac

SEQ ID NO: 455 - DNA, 20 bp, Unknown
  Description of Unknown: target sequence
ttcctagatgggagacaggc

SEQ ID NO: 456 - DNA, 20 bp, Unknown
  Description of Unknown: target sequence
ccaggtgtctgaggaggaag

SEQ ID NO: 457 - DNA, 20 bp, Unknown
  Description of Unknown: target sequence
gtgtctgaggaggaagggga

SEQ ID NO: 458 - DNA, 20 bp, Unknown
  Description of Unknown: target sequence
tagtcctgggtggggtaggg

SEQ ID NO: 459 - DNA, 20 bp, Unknown
  Description of Unknown: target sequence
agtcctgggtggggtagggt

SEQ ID NO: 460 - DNA, 20 bp, Unknown
  Description of Unknown: target sequence
cattacctcatagtaggcaa

SEQ ID NO: 461 - DNA, 20 bp, Unknown
  Description of Unknown: target sequence
ccattacctcatagtaggca

SEQ ID NO: 462 - DNA, 20 bp, Unknown
  Description of Unknown: target sequence
acagatctgagcagataaca

SEQ ID NO: 463 - DNA, 20 bp, Unknown
  Description of Unknown: target sequence
tcctacccactggttgccct

SEQ ID NO: 464 - DNA, 20 bp, Unknown
  Description of Unknown: target sequence
aggtgcagtacctgaaggac

SEQ ID NO: 465 - DNA, 20 bp, Unknown
  Description of Unknown: target sequence
caggcagctggcgggcgcca

SEQ ID NO: 466 - DNA, 20 bp, Unknown
  Description of Unknown: target sequence
gacttccagggctccttctg

SEQ ID NO: 467 - DNA, 20 bp, Unknown
  Description of Unknown: target sequence
catccagatacattttgtca

SEQ ID NO: 468 - DNA, 20 bp, Unknown
  Description of Unknown: target sequence
acctgccaaacacagacagt

SEQ ID NO: 469 - DNA, 20 bp, Unknown
  Description of Unknown: target sequence
cgtgcagatgcaatggtcca

SEQ ID NO: 470 - DNA, 20 bp, Unknown
  Description of Unknown: target sequence
tgtaactgtaacaaaacata

SEQ ID NO: 471 - DNA, 20 bp, Unknown
  Description of Unknown: target sequence
acttaccaccgaccatgcat

SEQ ID NO: 472 - DNA, 20 bp, Unknown
  Description of Unknown: target sequence
cttaccaaaaaccttgactg

SEQ ID NO: 473 - DNA, 20 bp, Unknown
  Description of Unknown: target sequence
ccagtccaaatcttcgatga

SEQ ID NO: 474 - DNA, 20 bp, Unknown
  Description of Unknown: target sequence
cagtccaaatcttcgatgat

SEQ ID NO: 475 - DNA, 20 bp, Unknown
  Description of Unknown: target sequence
aaaccatgtgatatttgctt

SEQ ID NO: 476 - DNA, 20 bp, Unknown
  Description of Unknown: target sequence
atgttccacactttatttcc

SEQ ID NO: 477 - DNA, 20 bp, Unknown
  Description of Unknown: target sequence
tcacgttgaggagtggtgtt

SEQ ID NO: 478 - DNA, 20 bp, Unknown
  Description of Unknown: target sequence
cattgtctagggatataaag

SEQ ID NO: 479 - DNA, 20 bp, Unknown
  Description of Unknown: target sequence
acattgtctagggatataaa

SEQ ID NO: 480 - DNA, 20 bp, Unknown
  Description of Unknown: target sequence
gacattgtctagggatataa

SEQ ID NO: 481 - DNA, 20 bp, Unknown
  Description of Unknown: target sequence
tggccaggacattccatctt

SEQ ID NO: 482 - DNA, 20 bp, Unknown
  Description of Unknown: target sequence
ccattctaggaacaaaatat

SEQ ID NO: 483 - DNA, 20 bp, Unknown
  Description of Unknown: target sequence
gagcttccaagtcttctcca

SEQ ID NO: 484 - DNA, 20 bp, Unknown
  Description of Unknown: target sequence
tccccgaaaaggtcgaattt

SEQ ID NO: 485 - DNA, 20 bp, Unknown
  Description of Unknown: target sequence
atgaagaacagtcacaggac

SEQ ID NO: 486 - DNA, 20 bp, Unknown
  Description of Unknown: target sequence
gatttcgtctgtaggcacaa

SEQ ID NO: 487 - DNA, 20 bp, Unknown
  Description of Unknown: target sequence
taaacttacctgaaacagcc

SEQ ID NO: 488 - DNA, 20 bp, Unknown
  Description of Unknown: target sequence
attcagacagtgccttcatg

SEQ ID NO: 489 - DNA, 20 bp, Unknown
  Description of Unknown: target sequence
gttgcactcgattgggacag

SEQ ID NO: 490 - DNA, 20 bp, Unknown
  Description of Unknown: target sequence
ttatttcaagccctgattga

SEQ ID NO: 491 - DNA, 20 bp, Unknown
  Description of Unknown: target sequence
ttacctgtgtaacttttata

SEQ ID NO: 492 - DNA, 20 bp, Unknown
  Description of Unknown: target sequence
attgttcctggaatttgggg

SEQ ID NO: 493 - DNA, 20 bp, Unknown
  Description of Unknown: target sequence
attatacctgccatgccgta

SEQ ID NO: 494 - DNA, 20 bp, Unknown
  Description of Unknown: target sequence
gttcctggaatttggggagg

SEQ ID NO: 495 - DNA, 20 bp, Unknown
  Description of Unknown: target sequence
ctgccatgccgtaaggcaag

SEQ ID NO: 496 - DNA, 20 bp, Unknown
  Description of Unknown: target sequence
tctacctttggtgaacccgt

SEQ ID NO: 497 - DNA, 20 bp, Unknown
  Description of Unknown: target sequence
cttaccttagctccttctaa

SEQ ID NO: 498 - DNA, 20 bp, Unknown
  Description of Unknown: target sequence
gggatgtcgactcctagggg

SEQ ID NO: 499 - DNA, 20 bp, Unknown
  Description of Unknown: target sequence
cgagggcaccatgcttcaag

SEQ ID NO: 500 - DNA, 20 bp, Unknown
  Description of Unknown: target sequence
aaactcactttatgctaggg

SEQ ID NO: 501 - DNA, 20 bp, Unknown
  Description of Unknown: target sequence
ctcactttatgctagggagg

SEQ ID NO: 502 - DNA, 20 bp, Unknown
  Description of Unknown: target sequence
cttcacctgcatttaaagaa

SEQ ID NO: 503 - DNA, 20 bp, Unknown
  Description of Unknown: target sequence
ccaccagattagctctggcc

SEQ ID NO: 504 - DNA, 20 bp, Unknown
  Description of Unknown: target sequence
ctacctttggtgaacccgtt

SEQ ID NO: 505 - DNA, 20 bp, Unknown
  Description of Unknown: target sequence
atgttccagatgtccagata

SEQ ID NO: 506 - DNA, 20 bp, Unknown
  Description of Unknown: target sequence
tgttccagatgtccagatat

SEQ ID NO: 507 - DNA, 20 bp, Unknown
  Description of Unknown: target sequence
agatagacaaacaagttgga

SEQ ID NO: 508 - DNA, 20 bp, Unknown
  Description of Unknown: target sequence
agcttgcaccaagtcacatg

SEQ ID NO: 509 - DNA, 20 bp, Unknown
  Description of Unknown: target sequence
acccaccttggtgccttctc

SEQ ID NO: 510 - DNA, 20 bp, Unknown
  Description of Unknown: target sequence
actcacgctggatagcctcc

SEQ ID NO: 511 - DNA, 20 bp, Unknown
  Description of Unknown: target sequence
tggagtacctgaggaatatc

SEQ ID NO: 512 - DNA, 20 bp, Unknown
  Description of Unknown: target sequence
ttaccccacttaactatctt

SEQ ID NO: 513 - DNA, 20 bp, Unknown
  Description of Unknown: target sequence
tcgatctatgaaaaagacag

SEQ ID NO: 514 - DNA, 18 bp, Unknown
  Description of Unknown: target sequence
taccccacttaactatct

SEQ ID NO: 515 - DNA, 20 bp, Unknown
  Description of Unknown: target sequence
ctcaggtactccaaagattc

SEQ ID NO: 516 - DNA, 20 bp, Unknown
  Description of Unknown: target sequence
cttaccccacttaactatct

SEQ ID NO: 517 - DNA, 20 bp, Unknown
  Description of Unknown: target sequence
catttgccagacagaacctc

SEQ ID NO: 518 - DNA, 20 bp, Unknown
  Description of Unknown: target sequence
aaacaagaccaaaaggctaa

SEQ ID NO: 519 - DNA, 20 bp, Unknown
  Description of Unknown: target sequence
gtaagccaagaaagaaatcc

SEQ ID NO: 520 - DNA, 20 bp, Unknown
  Description of Unknown: target sequence
gcttcagattctgaatgagc

SEQ ID NO: 521 - DNA, 20 bp, Unknown
  Description of Unknown: target sequence
ttaaaacaaaatgaaatgaa

SEQ ID NO: 522 - DNA, 20 bp, Unknown
  Description of Unknown: target sequence
gttcctcagcttccttcaga

SEQ ID NO: 523 - DNA, 20 bp, Unknown
  Description of Unknown: target sequence
caaagagcaagagattctga

SEQ ID NO: 524 - DNA, 20 bp, Unknown
  Description of Unknown: target sequence
aaagagcaagagattctgaa

SEQ ID NO: 525 - DNA, 20 bp, Unknown
  Description of Unknown: target sequence
acacagcactatctgaaacc

SEQ ID NO: 526 - DNA, 20 bp, Unknown
  Description of Unknown: target sequence
cacccagaaaacaacacagc

SEQ ID NO: 527 - DNA, 20 bp, Unknown
  Description of Unknown: target sequence
taccaagttgaaatgaatca

SEQ ID NO: 528 - DNA, 20 bp, Unknown
  Description of Unknown: target sequence
atgaatcaagggcagtccca

SEQ ID NO: 529 - DNA, 20 bp, Unknown
  Description of Unknown: target sequence
agggcagtcccaaggtacag

SEQ ID NO: 530 - DNA, 20 bp, Unknown
  Description of Unknown: target sequence
gttccaaaaaccctcacacc

SEQ ID NO: 531 - DNA, 20 bp, Unknown
  Description of Unknown: target sequence
gaaacagcacttgaatcaac

SEQ ID NO: 532 - DNA, 20 bp, Unknown
  Description of Unknown: target sequence
attacaaataaagaataaag

SEQ ID NO: 533 - DNA, 20 bp, Unknown
  Description of Unknown: target sequence
taatgtccaaatgggactgg

SEQ ID NO: 534 - DNA, 20 bp, Unknown
  Description of Unknown: target sequence
caaagcaagatcttcttcac

SEQ ID NO: 535 - DNA, 20 bp, Unknown
  Description of Unknown: target sequence
acaacaagcttcagttctac

SEQ ID NO: 536 - DNA, 20 bp, Unknown
  Description of Unknown: target sequence
ctgcgcaacttgctcagcaa

SEQ ID NO: 537 - DNA, 20 bp, Unknown
  Description of Unknown: target sequence
cactcagacccctccccaga

SEQ ID NO: 538 - DNA, 20 bp, Unknown
  Description of Unknown: target sequence
tttttccatgttttgttttc

SEQ ID NO: 539 - DNA, 20 bp, Unknown
  Description of Unknown: target sequence
ttacctacacatctgcaaga

SEQ ID NO: 540 - DNA, 20 bp, Unknown
  Description of Unknown: target sequence
acacttacccacttagcaat

SEQ ID NO: 541 - DNA, 20 bp, Unknown
  Description of Unknown: target sequence
catgcagaatggcagcacat

SEQ ID NO: 542 - DNA, 20 bp, Unknown
  Description of Unknown: target sequence
aagctcaggaggagaaaaaa

SEQ ID NO: 543 - DNA, 20 bp, Unknown
  Description of Unknown: target sequence
cgcaagccaggctaaacagt

SEQ ID NO: 544 - DNA, 20 bp, Unknown
  Description of Unknown: target sequence
ttctccccagtctcagccga

SEQ ID NO: 545 - DNA, 20 bp, Unknown
  Description of Unknown: target sequence
tggtcaggaaaagcagccat

SEQ ID NO: 546 - DNA, 20 bp, Unknown
  Description of Unknown: target sequence
ctagtccagggtgtggcttc

SEQ ID NO: 547 - DNA, 20 bp, Unknown
  Description of Unknown: target sequence
ccccaaaatcaacatggcag

SEQ ID NO: 548 - DNA, 20 bp, Unknown
  Description of Unknown: target sequence
tgtgatccagcagccttctt

SEQ ID NO: 549 - DNA, 20 bp, Unknown
  Description of Unknown: target sequence
gaccagatcaaggccataag

SEQ ID NO: 550 - DNA, 20 bp, Unknown
  Description of Unknown: target sequence
caagacaagaaaagcatgaa

SEQ ID NO: 551 - DNA, 20 bp, Unknown
  Description of Unknown: target sequence
ctgaacagggactgttagga

SEQ ID NO: 552 - DNA, 20 bp, Unknown
  Description of Unknown: target sequence
ccagagctcagagtggcaac

SEQ ID NO: 553 - DNA, 20 bp, Unknown
  Description of Unknown: target sequence
ttgctgcagacgccccgtga

SEQ ID NO: 554 - DNA, 20 bp, Unknown
  Description of Unknown: target sequence
ctgcagacgccccgtgacgg

SEQ ID NO: 555 - DNA, 20 bp, Unknown
  Description of Unknown: target sequence
cgacaagcagtgcctttgct

SEQ ID NO: 556 - DNA, 20 bp, Unknown
  Description of Unknown: target sequence
gcccagaacgtgattgacta

SEQ ID NO: 557 - DNA, 20 bp, Unknown
  Description of Unknown: target sequence
tgtgccaggggtgttatgac

SEQ ID NO: 558 - DNA, 20 bp, Unknown
  Description of Unknown: target sequence
cagatccagtctgatggcag

SEQ ID NO: 559 - DNA, 20 bp, Unknown
  Description of Unknown: target sequence
tgtacacgatggtcagccat

SEQ ID NO: 560 - DNA, 20 bp, Unknown
  Description of Unknown: target sequence
ttttaccttggggctctgac

SEQ ID NO: 561 - DNA, 20 bp, Unknown
  Description of Unknown: target sequence
agccccaaggtaaaaaggcc

SEQ ID NO: 562 - DNA, 20 bp, Unknown
  Description of Unknown: target sequence
gagccccaaggtaaaaaggc

SEQ ID NO: 563 - DNA, 20 bp, Unknown
  Description of Unknown: target sequence
cagctcacagtgtgccacca

SEQ ID NO: 564 - DNA, 20 bp, Unknown
  Description of Unknown: target sequence
tatgaccagatggacctggc

SEQ ID NO: 565 - DNA, 20 bp, Unknown
  Description of Unknown: target sequence
actggaccagtatgtcttcc

SEQ ID NO: 566 - DNA, 20 bp, Unknown
  Description of Unknown: target sequence
tgtcttccaggactcccagc

SEQ ID NO: 567 - DNA, 20 bp, Unknown
  Description of Unknown: target sequence
ttcaaccaggagccagcctc

SEQ ID NO: 568 - DNA, 20 bp, Unknown
  Description of Unknown: target sequence
gaccagattcccagtatgtt

SEQ ID NO: 569 - DNA, 20 bp, Unknown
  Description of Unknown: target sequence
taacatactgggaatctggt

SEQ ID NO: 570 - DNA, 20 bp, Unknown
  Description of Unknown: target sequence
aaaggcactgcaagagacaa

SEQ ID NO: 571 - DNA, 20 bp, Unknown
  Description of Unknown: target sequence
ctctggcaaatctctgaggc

SEQ ID NO: 572 - DNA, 20 bp, Unknown
  Description of Unknown: target sequence
agccaagtaccccctcccag

SEQ ID NO: 573 - DNA, 20 bp, Unknown
  Description of Unknown: target sequence
acctcccgagcaaacatgac

SEQ ID NO: 574 - DNA, 20 bp, Unknown
  Description of Unknown: target sequence
ccttacctgtcatgtttgct

SEQ ID NO: 575 - DNA, 20 bp, Unknown
  Description of Unknown: target sequence
tgctctggagatggagaagc

SEQ ID NO: 576 - DNA, 20 bp, Unknown
  Description of Unknown: target sequence
cccacccaatgcccggcagc

SEQ ID NO: 577 - DNA, 20 bp, Unknown
  Description of Unknown: target sequence
aggccattttggaagcttgt

SEQ ID NO: 578 - DNA, 20 bp, Unknown
  Description of Unknown: target sequence
accggctctgcaaaggccag

SEQ ID NO: 579 - DNA, 20 bp, Unknown
  Description of Unknown: target sequence
tggtgcaggccaggctggag

SEQ ID NO: 580 - DNA, 20 bp, Unknown
  Description of Unknown: target sequence
gaacggcagctggcccaagg

SEQ ID NO: 581 - DNA, 20 bp, Unknown
  Description of Unknown: target sequence
ggcccaaggaggcctggctg

SEQ ID NO: 582 - DNA, 20 bp, Unknown
  Description of Unknown: target sequence
gacacgagtgattgctgtgc

SEQ ID NO: 583 - DNA, 20 bp, Unknown
  Description of Unknown: target sequence
ctggtcagggcaagagctat

SEQ ID NO: 584 - DNA, 20 bp, Unknown
  Description of Unknown: target sequence
gggcccacagccactcgtgg

SEQ ID NO: 585 - DNA, 20 bp, Unknown
  Description of Unknown: target sequence
ttccagaagaagctgctccg

SEQ ID NO: 586 - DNA, 20 bp, Unknown
  Description of Unknown: target sequence
cctggtccagagcctgagca

SEQ ID NO: 587 - DNA, 20 bp, Unknown
  Description of Unknown: target sequence
cagacatcaaagtaccctac

SEQ ID NO: 588 - DNA, 20 bp, Unknown
  Description of Unknown: target sequence
acatcaaagtaccctacagg

SEQ ID NO: 589 - DNA, 20 bp, Unknown
  Description of Unknown: target sequence
cgcccaggtcctcacgtctg

SEQ ID NO: 590 - DNA, 20 bp, Unknown
  Description of Unknown: target sequence
cttagtccaacacccaccgc

SEQ ID NO: 591 - DNA, 20 bp, Unknown
  Description of Unknown: target sequence
cctcctgcaatgcttcctgg

SEQ ID NO: 592 - DNA, 20 bp, Unknown
  Description of Unknown: target sequence
gagccagccacagggccccc

SEQ ID NO: 593 - DNA, 20 bp, Unknown
  Description of Unknown: target sequence
ggaagcagaaggtgcttgcg

SEQ ID NO: 594 - DNA, 20 bp, Unknown
  Description of Unknown: target sequence
ggctgcagccggggacactg

SEQ ID NO: 595 - DNA, 20 bp, Unknown
  Description of Unknown: target sequence
ctgccaaattccagcctcct

SEQ ID NO: 596 - DNA, 20 bp, Unknown
  Description of Unknown: target sequence
ggcgggccaagacttctccc

SEQ ID NO: 597 - DNA, 20 bp, Unknown
  Description of Unknown: target sequence
agactcagaggtgagaggag

SEQ ID NO: 598 - DNA, 20 bp, Unknown
  Description of Unknown: target sequence
agcctaggaggcaaagagca

SEQ ID NO: 599 - DNA, 20 bp, Unknown
  Description of Unknown: target sequence
cccccaggctttccccaaac

SEQ ID NO: 600 - DNA, 20 bp, Unknown
  Description of Unknown: target sequence
tcactccagatgctgcaggg

SEQ ID NO: 601 - DNA, 20 bp, Unknown
  Description of Unknown: target sequence
aggctgcaggtggaatcaga

SEQ ID NO: 602 - DNA, 20 bp, Unknown
  Description of Unknown: target sequence
cttcccccagctgaagtcct

SEQ ID NO: 603 - DNA, 20 bp, Unknown
  Description of Unknown: target sequence
cactcacttgagggtttcca

SEQ ID NO: 604 - DNA, 20 bp, Unknown
  Description of Unknown: target sequence
cagactgcggggacacagtg

SEQ ID NO: 605 - DNA, 20 bp, Unknown
  Description of Unknown: target sequence
ccactcaccttagcctgagc

SEQ ID NO: 606 - DNA, 20 bp, Unknown
  Description of Unknown: target sequence
cactcaccttagcctgagca

SEQ ID NO: 607 - DNA, 20 bp, Unknown
  Description of Unknown: target sequence
gtacaagctgtcggaaacag

SEQ ID NO: 608 - DNA, 20 bp, Unknown
  Description of Unknown: target sequence
acactcactccatcacccgg

SEQ ID NO: 609 - DNA, 20 bp, Unknown
  Description of Unknown: target sequence
cactcactccatcacccgga

SEQ ID NO: 610 - DNA, 20 bp, Unknown
  Description of Unknown: target sequence
cgtccagtacaacaagttca

SEQ ID NO: 611 - DNA, 20 bp, Unknown
  Description of Unknown: target sequence
ccacatcctgcaagggggga

SEQ ID NO: 612 - DNA, 20 bp, Unknown
  Description of Unknown: target sequence
cacatcctgcaaggggggat

SEQ ID NO: 613 - DNA, 20 bp, Unknown
  Description of Unknown: target sequence
tgggcgtccacatcctgcaa

SEQ ID NO: 614 - DNA, 20 bp, Unknown
  Description of Unknown: target sequence
gggcgtccacatcctgcaag

SEQ ID NO: 615 - DNA, 20 bp, Unknown
  Description of Unknown: target sequence
ggcgtccacatcctgcaagg

SEQ ID NO: 616 - DNA, 20 bp, Unknown
  Description of Unknown: target sequence
gcgtccacatcctgcaaggg

SEQ ID NO: 617 - DNA, 20 bp, Unknown
  Description of Unknown: target sequence
gcccaaggtaagagcttccc

SEQ ID NO: 618 - DNA, 20 bp, Unknown
  Description of Unknown: target sequence
gctcttaccttgggcagcca

SEQ ID NO: 619 - DNA, 20 bp, Unknown
  Description of Unknown: target sequence
agctcttaccttgggcagcc

SEQ ID NO: 620 - DNA, 20 bp, Unknown
  Description of Unknown: target sequence
tgcacctctggggaggacct

SEQ ID NO: 621 - DNA, 20 bp, Unknown
  Description of Unknown: target sequence
ctgcacctctggggaggacc

SEQ ID NO: 622 - DNA, 20 bp, Unknown
  Description of Unknown: target sequence
cgcctgcagctgtcggacac

SEQ ID NO: 623 - DNA, 20 bp, Unknown
  Description of Unknown: target sequence
cacctgccaggccatcacgg

SEQ ID NO: 624 - DNA, 20 bp, Unknown
  Description of Unknown: target sequence
ccctacctgtcaccaggacc

SEQ ID NO: 625 - DNA, 20 bp, Unknown
  Description of Unknown: target sequence
cctacctgtcaccaggacca

SEQ ID NO: 626 - DNA, 20 bp, Unknown
  Description of Unknown: target sequence
cctctgagaaggaaaaaaga

SEQ ID NO: 627 - DNA, 20 bp, Unknown
  Description of Unknown: target sequence
cagaggaacagtcccaagga

SEQ ID NO: 628 - DNA, 20 bp, Unknown
  Description of Unknown: target sequence
cactcacctgcccacagcag

SEQ ID NO: 629 - DNA, 20 bp, Unknown
  Description of Unknown: target sequence
ccactcacctgcccacagca

SEQ ID NO: 630 - DNA, 20 bp, Unknown
  Description of Unknown: target sequence
gccactcacctgcccacagc

SEQ ID NO: 631 - DNA, 20 bp, Unknown
  Description of Unknown: target sequence
agggcccctgtggggaaacg

SEQ ID NO: 632 - DNA, 20 bp, Unknown
  Description of Unknown: target sequence
gggcccctgtggggaaacga

SEQ ID NO: 633 - DNA, 20 bp, Unknown
  Description of Unknown: target sequence
gcaagtgcaggagtcagtga

SEQ ID NO: 634 - DNA, 20 bp, Unknown
  Description of Unknown: target sequence
cggaaccagtaaccatgaac

SEQ ID NO: 635 - DNA, 20 bp, Unknown
  Description of Unknown: target sequence
ggaaccagtaaccatgaact

SEQ ID NO: 636 - DNA, 20 bp, Unknown
  Description of Unknown: target sequence
gaaccagtaaccatgaactg

SEQ ID NO: 637 - DNA, 20 bp, Unknown
  Description of Unknown: target sequence
gctagatcaagaagtacagg

SEQ ID NO: 638 - DNA, 20 bp, Unknown
  Description of Unknown: target sequence
agaagtacaggaggagactc

SEQ ID NO: 639 - DNA, 20 bp, Unknown
  Description of Unknown: target sequence
caagtctagtgaggagaaag

SEQ ID NO: 640 - DNA, 20 bp, Unknown
  Description of Unknown: target sequence
aagtctagtgaggagaaaga

SEQ ID NO: 641 - DNA, 20 bp, Unknown
  Description of Unknown: target sequence
agtctagtgaggagaaagag

SEQ ID NO: 642 - DNA, 20 bp, Unknown
  Description of Unknown: target sequence
acaggcccaggacacagagc

SEQ ID NO: 643 - DNA, 20 bp, Unknown
  Description of Unknown: target sequence
acctgtcaggtgaagttcgc

SEQ ID NO: 644 - DNA, 20 bp, Unknown
  Description of Unknown: target sequence
acttacaggtgacgttgagc

SEQ ID NO: 645 - DNA, 20 bp, Unknown
  Description of Unknown: target sequence
aacatctaggagaggaagag

SEQ ID NO: 646 - DNA, 20 bp, Unknown
  Description of Unknown: target sequence
gttccacagaacccaacaac

SEQ ID NO: 647 - DNA, 20 bp, Unknown
  Description of Unknown: target sequence
ttcctacctgagccatctcc

SEQ ID NO: 648 - DNA, 20 bp, Unknown
  Description of Unknown: target sequence
atgctcacatgaagaagatg

SEQ ID NO: 649 - DNA, 20 bp, Unknown
  Description of Unknown: target sequence
gggaaacaagagaccagagc

SEQ ID NO: 650 - DNA, 20 bp, Unknown
  Description of Unknown: target sequence
tcactctgatgggagacacc

SEQ ID NO: 651 - DNA, 20 bp, Unknown
  Description of Unknown: target sequence
cactctgatgggagacacca

SEQ ID NO: 652 - DNA, 20 bp, Unknown
  Description of Unknown: target sequence
tttcttatggagaggaaaga

SEQ ID NO: 653 - DNA, 20 bp, Unknown
  Description of Unknown: target sequence
gtacaggtaagagcaacgcc

SEQ ID NO: 654 - DNA, 20 bp, Unknown
  Description of Unknown: target sequence
ctcttacctgtaccataacc

SEQ ID NO: 655 - DNA, 20 bp, Unknown
  Description of Unknown: target sequence
ttacctgtaccataaccagg

SEQ ID NO: 656 - DNA, 20 bp, Unknown
  Description of Unknown: target sequence
tgtatctgtaggaggagaag

SEQ ID NO: 657 - DNA, 20 bp, Unknown
  Description of Unknown: target sequence
gtatctgtaggaggagaagt

SEQ ID NO: 658 - DNA, 20 bp, Unknown
  Description of Unknown: target sequence
cagatacaaactggactctc

SEQ ID NO: 659 - DNA, 20 bp, Unknown
  Description of Unknown: target sequence
tcttaccttccttcgtttgc

SEQ ID NO: 660 - DNA, 20 bp, Unknown
  Description of Unknown: target sequence
tttggatctaaaacggtgac

SEQ ID NO: 661 - DNA, 20 bp, Unknown
  Description of Unknown: target sequence
gatctaaaacggtgacaggt

SEQ ID NO: 662 - DNA, 20 bp, Unknown
  Description of Unknown: target sequence
aaaggctcagcagttgacct

SEQ ID NO: 663 - DNA, 20 bp, Unknown
  Description of Unknown: target sequence
atttaccggcatagaatagt

SEQ ID NO: 664 - DNA, 20 bp, Unknown
  Description of Unknown: target sequence
tcactgcctaagagagacat

SEQ ID NO: 665 - DNA, 20 bp, Unknown
  Description of Unknown: target sequence
aggatccacgtggagaatgg

SEQ ID NO: 666 - DNA, 20 bp, Unknown
  Description of Unknown: target sequence
ggatccacgtggagaatggt

SEQ ID NO: 667 - DNA, 20 bp, Unknown
  Description of Unknown: target sequence
tctcactgttctcagggaag

SEQ ID NO: 668 - DNA, 20 bp, Unknown
  Description of Unknown: target sequence
cctgcccaaggcttcccacc

SEQ ID NO: 669 - DNA, 20 bp, Unknown
  Description of Unknown: target sequence
ctgcccaaggcttcccacct

SEQ ID NO: 670 - DNA, 20 bp, Unknown
  Description of Unknown: target sequence
gcctgctgcggtaagcggta

SEQ ID NO: 671 - DNA, 20 bp, Unknown
  Description of Unknown: target sequence
gatgctcagggaacacgtat

SEQ ID NO: 672 - DNA, 20 bp, Unknown
  Description of Unknown: target sequence
ttctcaaagttcccacatcc

SEQ ID NO: 673 - DNA, 20 bp, Unknown
  Description of Unknown: target sequence
tcacagattggtgagtagcc

SEQ ID NO: 674 - DNA, 20 bp, Unknown
  Description of Unknown: target sequence
ctcacctgttctgtgattac

SEQ ID NO: 675 - DNA, 20 bp, Unknown
  Description of Unknown: target sequence
tccttccagctactcaatcc

SEQ ID NO: 676 - DNA, 20 bp, Unknown
  Description of Unknown: target sequence
cacagtacaaataagagccc

SEQ ID NO: 677 - DNA, 20 bp, Unknown
  Description of Unknown: target sequence
ccccccagcgcttcggtgag

SEQ ID NO: 678 - DNA, 20 bp, Unknown
  Description of Unknown: target sequence
cccccagcgcttcggtgagt

SEQ ID NO: 679 - DNA, 20 bp, Unknown
  Description of Unknown: target sequence
ccactcaccgaagcgctggg

SEQ ID NO: 680 - DNA, 20 bp, Unknown
  Description of Unknown: target sequence
tacctcggaggaaagagaaa

SEQ ID NO: 681 - DNA, 20 bp, Unknown
  Description of Unknown: target sequence
cagcttccaaaacgacaagc

SEQ ID NO: 682 - DNA, 20 bp, Unknown
  Description of Unknown: target sequence
aacataccagcttgtcgttt

SEQ ID NO: 683 - DNA, 20 bp, Unknown
  Description of Unknown: target sequence
agaccacctgcagagacgag

SEQ ID NO: 684 - DNA, 20 bp, Unknown
  Description of Unknown: target sequence
ccacctgcagagacgagagg

SEQ ID NO: 685 - DNA, 20 bp, Unknown
  Description of Unknown: target sequence
ccacacccaaaaggccacac

SEQ ID NO: 686 - DNA, 20 bp, Unknown
  Description of Unknown: target sequence
cccaccagctcagctccacg

SEQ ID NO: 687 - DNA, 20 bp, Unknown
  Description of Unknown: target sequence
cgctgtcaagtccagttcta

SEQ ID NO: 688 - DNA, 20 bp, Unknown
  Description of Unknown: target sequence
gctgtcaagtccagttctac

SEQ ID NO: 689 - DNA, 20 bp, Unknown
  Description of Unknown: target sequence
cacccagatcgtcagcgccg

SEQ ID NO: 690 - DNA, 20 bp, Unknown
  Description of Unknown: target sequence
ccactcacctgctctacccc

SEQ ID NO: 691 - DNA, 20 bp, Unknown
  Description of Unknown: target sequence
ccacagtctgaaagaaagca

SEQ ID NO: 692 - DNA, 20 bp, Unknown
  Description of Unknown: target sequence
gacactgttggcacggagga

SEQ ID NO: 693 - DNA, 20 bp, Unknown
  Description of Unknown: target sequence
ttaccatggccatcaacaca

SEQ ID NO: 694 - DNA, 20 bp, Unknown
  Description of Unknown: target sequence
ccacagtctgaaagaaaaca

SEQ ID NO: 695 - DNA, 20 bp, Unknown
  Description of Unknown: target sequence
cacagtctgaaagaaaacag

SEQ ID NO: 696 - DNA, 20 bp, Unknown
  Description of Unknown: target sequence
ttaccatggccatcagcacg

SEQ ID NO: 697 - DNA, 20 bp, Unknown
  Description of Unknown: target sequence
tctgcgttcaggggtaagcg

SEQ ID NO: 698 - DNA, 20 bp, Unknown
  Description of Unknown: target sequence
gcgcttacccctgaacgcag

SEQ ID NO: 699 - DNA, 20 bp, Unknown
  Description of Unknown: target sequence
gactgggcagcggcccctgt

SEQ ID NO: 700 - DNA, 20 bp, Unknown
  Description of Unknown: target sequence
ggactgggcagcggcccctg

SEQ ID NO: 701 - DNA, 20 bp, Unknown
  Description of Unknown: target sequence
gtcatgcagcccttgcctgc

SEQ ID NO: 702 - DNA, 20 bp, Unknown
  Description of Unknown: target sequence
tcatgcagcccttgcctgct

SEQ ID NO: 703 - DNA, 20 bp, Unknown
  Description of Unknown: target sequence
catgcagcccttgcctgctg

SEQ ID NO: 704 - DNA, 20 bp, Unknown
  Description of Unknown: target sequence
ctcaccagattcccgaaggt

SEQ ID NO: 705 - DNA, 20 bp, Unknown
  Description of Unknown: target sequence
cagactcaccagattcccga

SEQ ID NO: 706 - DNA, 20 bp, Unknown
  Description of Unknown: target sequence
agcctaggcaagtgcagagg

SEQ ID NO: 707 - DNA, 20 bp, Unknown
  Description of Unknown: target sequence
cagcctaggcaagtgcagag

SEQ ID NO: 708 - DNA, 20 bp, Unknown
  Description of Unknown: target sequence
accagcctaggcaagtgcag

SEQ ID NO: 709 - DNA, 20 bp, Unknown
  Description of Unknown: target sequence
tggaaccccaataccagcct

SEQ ID NO: 710 - DNA, 20 bp, Unknown
  Description of Unknown: target sequence
cacctgcagaagatgccaga

SEQ ID NO: 711 - DNA, 20 bp, Unknown
  Description of Unknown: target sequence
cgctcacctgcaccagcctc

SEQ ID NO: 712 - DNA, 20 bp, Unknown
  Description of Unknown: target sequence
cttcctggcaagacacaaga

SEQ ID NO: 713 - DNA, 20 bp, Unknown
  Description of Unknown: target sequence
aattcagggagccattgaaa

SEQ ID NO: 714 - DNA, 20 bp, Unknown
  Description of Unknown: target sequence
ctactgacctgccttttcaa

SEQ ID NO: 715 - DNA, 20 bp, Unknown
  Description of Unknown: target sequence
gcctctcaaagtcttatgtg

SEQ ID NO: 716 - DNA, 20 bp, Unknown
  Description of Unknown: target sequence
ttcccatgctgctttacttc

SEQ ID NO: 717 - DNA, 20 bp, Unknown
  Description of Unknown: target sequence
tttaggtcaaccagatgtag

SEQ ID NO: 718 - DNA, 20 bp, Unknown
  Description of Unknown: target sequence
tgtgcctgaaagcaaaaatg

SEQ ID NO: 719 - DNA, 20 bp, Unknown
  Description of Unknown: target sequence
ttacctactattcttgccag

SEQ ID NO: 720 - DNA, 20 bp, Unknown
  Description of Unknown: target sequence
aaatgctgtttaaaaaaagg

SEQ ID NO: 721 - DNA, 20 bp, Unknown
  Description of Unknown: target sequence
ccccaaaaagtgaatatcaa

SEQ ID NO: 722 - DNA, 20 bp, Unknown
  Description of Unknown: target sequence
gtccagaatttccagaagta

SEQ ID NO: 723 - DNA, 20 bp, Unknown
  Description of Unknown: target sequence
tccctggaggggtgggggag

SEQ ID NO: 724 - DNA, 20 bp, Unknown
  Description of Unknown: target sequence
tcacttcaacaggactccta

SEQ ID NO: 725 - DNA, 20 bp, Unknown
  Description of Unknown: target sequence
ccttacactcaaaggcaaag

SEQ ID NO: 726 - DNA, 20 bp, Unknown
  Description of Unknown: target sequence
atggctgcagggagaggaag

SEQ ID NO: 727 - DNA, 20 bp, Unknown
  Description of Unknown: target sequence
ggagcgccaggggatgctgg

SEQ ID NO: 728 - DNA, 20 bp, Unknown
  Description of Unknown: target sequence
tcacgtcccatgcagccaca

SEQ ID NO: 729 - DNA, 20 bp, Unknown
  Description of Unknown: target sequence
tggacgtctggtggggagta

SEQ ID NO: 730 - DNA, 20 bp, Unknown
  Description of Unknown: target sequence
actcacattgatgaggaaga

SEQ ID NO: 731 - DNA, 20 bp, Unknown
  Description of Unknown: target sequence
cagcatctgagaaaggcaga

SEQ ID NO: 732 - DNA, 20 bp, Unknown
  Description of Unknown: target sequence
aatccaacacctcagcgatg

SEQ ID NO: 733 - DNA, 20 bp, Unknown
  Description of Unknown: target sequence
atccaacacctcagcgatgt

SEQ ID NO: 734 - DNA, 20 bp, Unknown
  Description of Unknown: target sequence
cgcggcgcagtacccgctgc

SEQ ID NO: 735 - DNA, 20 bp, Unknown
  Description of Unknown: target sequence
cactcaccgtggtgggtcgg

SEQ ID NO: 736 - DNA, 20 bp, Unknown
  Description of Unknown: target sequence
actcaccgtggtgggtcgga

SEQ ID NO: 737 - DNA, 20 bp, Unknown
  Description of Unknown: target sequence
tggctccctgtggggcaacg

SEQ ID NO: 738 - DNA, 20 bp, Unknown
  Description of Unknown: target sequence
gattccagggggaggcggtg

SEQ ID NO: 739 - DNA, 20 bp, Unknown
  Description of Unknown: target sequence
gctcctacctgtgctggacc

SEQ ID NO: 740 - DNA, 20 bp, Unknown
  Description of Unknown: target sequence
tcgccgccacagtggggtcg

SEQ ID NO: 741 - DNA, 20 bp, Unknown
  Description of Unknown: target sequence
cagactgagagtggggagag

SEQ ID NO: 742 - DNA, 20 bp, Unknown
  Description of Unknown: target sequence
cctcctccagagtgtggttg

SEQ ID NO: 743 - DNA, 20 bp, Unknown
  Description of Unknown: target sequence
agccatcccagggagagagc

SEQ ID NO: 744 - DNA, 20 bp, Unknown
  Description of Unknown: target sequence
gccatcccagggagagagct

SEQ ID NO: 745 - DNA, 20 bp, Unknown
  Description of Unknown: target sequence
ccatcccagggagagagctg

SEQ ID NO: 746 - DNA, 20 bp, Unknown
  Description of Unknown: target sequence
ctcacaggccacccaccagc

SEQ ID NO: 747 - DNA, 20 bp, Unknown
  Description of Unknown: target sequence
ccgcttccagaagtgcctgg

SEQ ID NO: 748 - DNA, 20 bp, Unknown
  Description of Unknown: target sequence
cttccagaagtgcctggcgg

SEQ ID NO: 749 - DNA, 20 bp, Unknown
  Description of Unknown: target sequence
acaactgcaaaggaatgggt

SEQ ID NO: 750 - DNA, 20 bp, Unknown
  Description of Unknown: target sequence
caactgcaaaggaatgggta

SEQ ID NO: 751 - DNA, 20 bp, Unknown
  Description of Unknown: target sequence
gaactaggaagacggtccag

SEQ ID NO: 752 - DNA, 20 bp, Unknown
  Description of Unknown: target sequence
ggctgaccaggacctgttgc

SEQ ID NO: 753 - DNA, 20 bp, Unknown
  Description of Unknown: target sequence
ctcacctgtacgccaggcgg

SEQ ID NO: 754 - DNA, 20 bp, Unknown
  Description of Unknown: target sequence
gctctcacctgtacgccagg

SEQ ID NO: 755 - DNA, 20 bp, Unknown
  Description of Unknown: target sequence
cttagacctggcaggcagat

SEQ ID NO: 756 - DNA, 20 bp, Unknown
  Description of Unknown: target sequence
caatccagtccccgaagcca

SEQ ID NO: 757 - DNA, 20 bp, Unknown
  Description of Unknown: target sequence
aatccagtccccgaagccac

SEQ ID NO: 758 - DNA, 20 bp, Unknown
  Description of Unknown: target sequence
actcaccggtgatgaggaca

SEQ ID NO: 759 - DNA, 20 bp, Unknown
  Description of Unknown: target sequence
ctcaccggtgatgaggacaa

SEQ ID NO: 760 - DNA, 20 bp, Unknown
  Description of Unknown: target sequence
ccggtctgcgggaagggtac

SEQ ID NO: 761 - DNA, 20 bp, Unknown
  Description of Unknown: target sequence
tgggctgcaggagccgcggc

SEQ ID NO: 762 - DNA, 20 bp, Unknown
  Description of Unknown: target sequence
ttgtaccaaatgcccctgtc

SEQ ID NO: 763 - DNA, 20 bp, Unknown
  Description of Unknown: target sequence
cggacagcagtcctccatta

SEQ ID NO: 764 - DNA, 20 bp, Unknown
  Description of Unknown: target sequence
aggtgcagcacagccccatg

SEQ ID NO: 765 - DNA, 20 bp, Unknown
  Description of Unknown: target sequence
ggtgcagcacagccccatgt

SEQ ID NO: 766 - DNA, 20 bp, Unknown
  Description of Unknown: target sequence
agttgccagatgcgcttcga

SEQ ID NO: 767 - DNA, 20 bp, Unknown
  Description of Unknown: target sequence
gttgccagatgcgcttcgac

SEQ ID NO: 768 - DNA, 20 bp, Unknown
  Description of Unknown: target sequence
gtctcagctgctcgacacgc

SEQ ID NO: 769 - DNA, 20 bp, Unknown
  Description of Unknown: target sequence
ttcttaccctggaatagtcc

SEQ ID NO: 770 - DNA, 20 bp, Unknown
  Description of Unknown: target sequence
attacctgtatgctaatcga

SEQ ID NO: 771 - DNA, 20 bp, Unknown
  Description of Unknown: target sequence
ttgcaatgcgttcgtggctt

SEQ ID NO: 772 - DNA, 20 bp, Unknown
  Description of Unknown: target sequence
actgacctgtgaccatagcc

SEQ ID NO: 773 - DNA, 20 bp, Unknown
  Description of Unknown: target sequence
tatctgcagggacagagaaa

SEQ ID NO: 774 - DNA, 20 bp, Unknown
  Description of Unknown: target sequence
tgcggcgcagacatacagct

SEQ ID NO: 775 - DNA, 20 bp, Unknown
  Description of Unknown: target sequence
ccccgcaggcgggggcgtta

SEQ ID NO: 776 - DNA, 20 bp, Unknown
  Description of Unknown: target sequence
tttcagaagtgtctcagtgt

SEQ ID NO: 777 - DNA, 20 bp, Unknown
  Description of Unknown: target sequence
attacctgatggaaagtctg

SEQ ID NO: 778 - DNA, 20 bp, Unknown
  Description of Unknown: target sequence
cttcagtgccttcgtggatt

SEQ ID NO: 779 - DNA, 20 bp, Unknown
  Description of Unknown: target sequence
tttctgcagagggatagaga

SEQ ID NO: 780 - DNA, 20 bp, Unknown
  Description of Unknown: target sequence
agaccaccagagtaagggac

SEQ ID NO: 781 - DNA, 20 bp, Unknown
  Description of Unknown: target sequence
acttgcagccctcggccaaa

SEQ ID NO: 782 - DNA, 20 bp, Unknown
  Description of Unknown: target sequence
agggctcaccagaggtagga

SEQ ID NO: 783 - DNA, 20 bp, Unknown
  Description of Unknown: target sequence
ttcacctgcccaaggaaaaa

SEQ ID NO: 784 - DNA, 20 bp, Unknown
  Description of Unknown: target sequence
ctaagcctagaaaatcagtt

SEQ ID NO: 785 - DNA, 20 bp, Unknown
  Description of Unknown: target sequence
acatctagaaaaaaaaatac

SEQ ID NO: 786 - DNA, 20 bp, Unknown
  Description of Unknown: target sequence
attaccttcctctttgcact

SEQ ID NO: 787 - DNA, 20 bp, Unknown
  Description of Unknown: target sequence
gatcctgtaggttggaacat

SEQ ID NO: 788 - DNA, 20 bp, Unknown
  Description of Unknown: target sequence
aagccaccccaagttagatc

SEQ ID NO: 789 - DNA, 20 bp, Unknown
  Description of Unknown: target sequence
aacttaccccaaacaattag

SEQ ID NO: 790 - DNA, 20 bp, Unknown
  Description of Unknown: target sequence
atacctacaggatttaaagt

SEQ ID NO: 791 - DNA, 20 bp, Unknown
  Description of Unknown: target sequence
gtttcctagaaagcaaaaaa

SEQ ID NO: 792 - DNA, 20 bp, Unknown
  Description of Unknown: target sequence
aagttcaactgcttcgtaat

SEQ ID NO: 793 - DNA, 20 bp, Unknown
  Description of Unknown: target sequence
aattcagactatcatcctca

SEQ ID NO: 794 - DNA, 20 bp, Unknown
  Description of Unknown: target sequence
gcttgcagctgtgggacacc

SEQ ID NO: 795 - DNA, 20 bp, Unknown
  Description of Unknown: target sequence
gaccactcaaccagtgccca

SEQ ID NO: 796 - DNA, 20 bp, Unknown
  Description of Unknown: target sequence
ggaggcacagaccactccac

SEQ ID NO: 797 - DNA, 20 bp, Unknown
  Description of Unknown: target sequence
ggcacagacaactcgactga

SEQ ID NO: 798 - DNA, 20 bp, Unknown
  Description of Unknown: target sequence
gcacagaccactcaacccac

SEQ ID NO: 799 - DNA, 20 bp, Unknown
  Description of Unknown: target sequence
gaccactcaacccacaggcc

SEQ ID NO: 800 - DNA, 20 bp, Unknown
  Description of Unknown: target sequence
gaccactcaaaccacagcca

SEQ ID NO: 801 - DNA, 20 bp, Unknown
  Description of Unknown: target sequence
gaccactcaacccacagcca

SEQ ID NO: 802 - DNA, 20 bp, Unknown
  Description of Unknown: target sequence
gaccactcaaccagcagcca

SEQ ID NO: 803 - RNA, 20 nt, Artificial Sequence
  Description of Artificial Sequence: Synthetic oligonucleotide
ccuuaccuagggacgcagcc

SEQ ID NO: 804 - RNA, 20 nt, Artificial Sequence
  Description of Artificial Sequence: Synthetic oligonucleotide
ggauccccagcgccagcugc

SEQ ID NO: 805 - RNA, 20 nt, Artificial Sequence
  Description of Artificial Sequence: Synthetic oligonucleotide
agcgccagcugccggccucc

SEQ ID NO: 806 - RNA, 20 nt, Artificial Sequence
  Description of Artificial Sequence: Synthetic oligonucleotide
gcgccagcugccggccucca

SEQ ID NO: 807 - RNA, 20 nt, Artificial Sequence
  Description of Artificial Sequence: Synthetic oligonucleotide
ccuggcucagcgccacgggc

SEQ ID NO: 808 - RNA, 20 nt, Artificial Sequence
  Description of Artificial Sequence: Synthetic oligonucleotide
gcugcaggugcagacaggug

SEQ ID NO: 809 - RNA, 20 nt, Artificial Sequence
  Description of Artificial Sequence: Synthetic oligonucleotide
gcgguaccacgucuuguaga

SEQ ID NO: 810 - RNA, 20 nt, Artificial Sequence
  Description of Artificial Sequence: Synthetic oligonucleotide
ugccugugggaacaaacaga

SEQ ID NO: 811 - RNA, 20 nt, Artificial Sequence
  Description of Artificial Sequence: Synthetic oligonucleotide
cuuacuuucacuauccuggg

SEQ ID NO: 812 - RNA, 20 nt, Artificial Sequence
  Description of Artificial Sequence: Synthetic oligonucleotide
ucccuuacuuucacuauccu

SEQ ID NO: 813 - RNA, 20 nt, Artificial Sequence
  Description of Artificial Sequence: Synthetic oligonucleotide
cucccaggauagugaaagua

SEQ ID NO: 814 - RNA, 20 nt, Artificial Sequence
  Description of Artificial Sequence: Synthetic oligonucleotide
ugaugucugaaagggcagag

SEQ ID NO: 815 - RNA, 20 nt, Artificial Sequence
  Description of Artificial Sequence: Synthetic oligonucleotide
ugcccaggagcuggugcgga

SEQ ID NO: 816 - RNA, 20 nt, Artificial Sequence
  Description of Artificial Sequence: Synthetic oligonucleotide
uugcugccacagaaccagaa

SEQ ID NO: 817 - RNA, 20 nt, Artificial Sequence
  Description of Artificial Sequence: Synthetic oligonucleotide
auucaagggauugaaaaccc

SEQ ID NO: 818 - RNA, 20 nt, Artificial Sequence
  Description of Artificial Sequence: Synthetic oligonucleotide
accugcccaggggauacccg

SEQ ID NO: 819 - RNA, 20 nt, Artificial Sequence
  Description of Artificial Sequence: Synthetic oligonucleotide
cagcggcagccuucugaguc

SEQ ID NO: 820 - RNA, 20 nt, Artificial Sequence
  Description of Artificial Sequence: Synthetic oligonucleotide
gcuacaaacaagcucaucuu

SEQ ID NO: 821 - RNA, 20 nt, Artificial Sequence
  Description of Artificial Sequence: Synthetic oligonucleotide
ccagccaaguacguaaguag

SEQ ID NO: 822 - RNA, 20 nt, Artificial Sequence
  Description of Artificial Sequence: Synthetic oligonucleotide
cuggauaucugugggacaag

SEQ ID NO: 823 - RNA, 20 nt, Artificial Sequence
  Description of Artificial Sequence: Synthetic oligonucleotide
cuuaccugggcuggggaaga

SEQ ID NO: 824 - RNA, 20 nt, Artificial Sequence
  Description of Artificial Sequence: Synthetic oligonucleotide
uucguaucuguaaaaccaag

SEQ ID NO: 825 - RNA, 20 nt, Artificial Sequence
  Description of Artificial Sequence: Synthetic oligonucleotide
uuucaaaaccugucagugau

SEQ ID NO: 826 - RNA, 20 nt, Artificial Sequence
  Description of Artificial Sequence: Synthetic oligonucleotide
uucaaaaccugucagugauu

SEQ ID NO: 827 - RNA, 20 nt, Artificial Sequence
  Description of Artificial Sequence: Synthetic oligonucleotide
ggacccugcauagagagaga

SEQ ID NO: 828 - RNA, 20 nt, Artificial Sequence
  Description of Artificial Sequence: Synthetic oligonucleotide
ugccccagcagacgggcacg

SEQ ID NO: 829 - RNA, 20 nt, Artificial Sequence
  Description of Artificial Sequence: Synthetic oligonucleotide
guuaccugggccaugucccc

SEQ ID NO: 830 - RNA, 20 nt, Artificial Sequence
  Description of Artificial Sequence: Synthetic oligonucleotide
cuuacuguuagauuuauauc

SEQ ID NO: 831 - RNA, 20 nt, Artificial Sequence
  Description of Artificial Sequence: Synthetic oligonucleotide
uuacuguuagauuuauauca

SEQ ID NO: 832 - RNA, 20 nt, Artificial Sequence
  Description of Artificial Sequence: Synthetic oligonucleotide
uuugcuauggaaacacaaac

SEQ ID NO: 833 - RNA, 20 nt, Artificial Sequence
  Description of Artificial Sequence: Synthetic oligonucleotide
uccauagcaaauauccacau

SEQ ID NO: 834 - RNA, 20 nt, Artificial Sequence
  Description of Artificial Sequence: Synthetic oligonucleotide
gcagcaacccucacaaccuu

SEQ ID NO: 835 - RNA, 20 nt, Artificial Sequence
  Description of Artificial Sequence: Synthetic oligonucleotide
cagcaacccucacaaccuuu

SEQ ID NO: 836 - RNA, 20 nt, Artificial Sequence
  Description of Artificial Sequence: Synthetic oligonucleotide
aggcaggcuccccucgccuc

SEQ ID NO: 837 - RNA, 20 nt, Artificial Sequence
  Description of Artificial Sequence: Synthetic oligonucleotide
ggagcagcaggaccagcuuc

SEQ ID NO: 838 - RNA, 20 nt, Artificial Sequence
  Description of Artificial Sequence: Synthetic oligonucleotide
caggaauaccugagcuuucu

SEQ ID NO: 839 - RNA, 20 nt, Artificial Sequence
  Description of Artificial Sequence: Synthetic oligonucleotide
agguuccagauuccauugcu

SEQ ID NO: 840 - RNA, 20 nt, Artificial Sequence
  Description of Artificial Sequence: Synthetic oligonucleotide
cugggcccaggggcugaggc

SEQ ID NO: 841 - RNA, 20 nt, Artificial Sequence
  Description of Artificial Sequence: Synthetic oligonucleotide
gaucgaguggccccaggucc

SEQ ID NO: 842 - RNA, 20 nt, Artificial Sequence
  Description of Artificial Sequence: Synthetic oligonucleotide
ucacccgacuucugaacgug

SEQ ID NO: 843 - RNA, 20 nt, Artificial Sequence
  Description of Artificial Sequence: Synthetic oligonucleotide
uuaccugcccacuguuagcc

SEQ ID NO: 844 - RNA, 20 nt, Artificial Sequence
  Description of Artificial Sequence: Synthetic oligonucleotide
gaagccacaggaagucugug

SEQ ID NO: 845 - RNA, 20 nt, Artificial Sequence
  Description of Artificial Sequence: Synthetic oligonucleotide
acuccaguuccugacggcug

SEQ ID NO: 846 - RNA, 20 nt, Artificial Sequence
  Description of Artificial Sequence: Synthetic oligonucleotide
accuacaggaguaccugacg

SEQ ID NO: 847 - RNA, 20 nt, Artificial Sequence
  Description of Artificial Sequence: Synthetic oligonucleotide
uucccagagcaccagagcca

SEQ ID NO: 848 - RNA, 20 nt, Artificial Sequence
  Description of Artificial Sequence: Synthetic oligonucleotide
acguucagaagucgggugag

SEQ ID NO: 849 - RNA, 20 nt, Artificial Sequence
  Description of Artificial Sequence: Synthetic oligonucleotide
uucagagcaguuugagacag

SEQ ID NO: 850 - RNA, 20 nt, Artificial Sequence
  Description of Artificial Sequence: Synthetic oligonucleotide
ccugcugggaaacagacaac

SEQ ID NO: 851 - RNA, 20 nt, Artificial Sequence
  Description of Artificial Sequence: Synthetic oligonucleotide
cacucacagucuaggguggc

SEQ ID NO: 852 - RNA, 20 nt, Artificial Sequence
  Description of Artificial Sequence: Synthetic oligonucleotide
acagggcuggggcaggacag

SEQ ID NO: 853 - RNA, 20 nt, Artificial Sequence
  Description of Artificial Sequence: Synthetic oligonucleotide
cauccaccagcucgcagcac

SEQ ID NO: 854 - RNA, 20 nt, Artificial Sequence
  Description of Artificial Sequence: Synthetic oligonucleotide
auccaccagcucgcagcaca

SEQ ID NO: 855 - RNA, 20 nt, Artificial Sequence
  Description of Artificial Sequence: Synthetic oligonucleotide
uccaccagcucgcagcacag

SEQ ID NO: 856 - RNA, 20 nt, Artificial Sequence
  Description of Artificial Sequence: Synthetic oligonucleotide
ccaccagcucgcagcacagg

SEQ ID NO: 857 - RNA, 20 nt, Artificial Sequence
  Description of Artificial Sequence: Synthetic oligonucleotide
ugucaccuggcaggaggagg

SEQ ID NO: 858 - RNA, 20 nt, Artificial Sequence
  Description of Artificial Sequence: Synthetic oligonucleotide
gucaccuggcaggaggaggc

SEQ ID NO: 859 - RNA, 20 nt, Artificial Sequence
  Description of Artificial Sequence: Synthetic oligonucleotide
ggcacccugcagggagaaga

SEQ ID NO: 860 - RNA, 20 nt, Artificial Sequence
  Description of Artificial Sequence: Synthetic oligonucleotide
gcacccugcagggagaagaa

SEQ ID NO: 861 - RNA, 20 nt, Artificial Sequence
  Description of Artificial Sequence: Synthetic oligonucleotide
auucugucguggguaggggc

SEQ ID NO: 862 - RNA, 20 nt, Artificial Sequence
  Description of Artificial Sequence: Synthetic oligonucleotide
cuccauucugucguggguag

SEQ ID NO: 863 - RNA, 20 nt, Artificial Sequence
  Description of Artificial Sequence: Synthetic oligonucleotide
ccucgggcugcaaaggagag

SEQ ID NO: 864 - RNA, 20 nt, Artificial Sequence
  Description of Artificial Sequence: Synthetic oligonucleotide
cgggcugcaaaggagagggg

SEQ ID NO: 865 - RNA, 20 nt, Artificial Sequence
  Description of Artificial Sequence: Synthetic oligonucleotide
gcugaccuuuccgguauccc

SEQ ID NO: 866 - RNA, 20 nt, Artificial Sequence
  Description of Artificial Sequence: Synthetic oligonucleotide
cugaccuuuccgguauccca

SEQ ID NO: 867 - RNA, 20 nt, Artificial Sequence
  Description of Artificial Sequence: Synthetic oligonucleotide
uguugcacugagauggggca

SEQ ID NO: 868 - RNA, 20 nt, Artificial Sequence
  Description of Artificial Sequence: Synthetic oligonucleotide
cuguugcacugagauggggc

SEQ ID NO: 869 - RNA, 20 nt, Artificial Sequence
  Description of Artificial Sequence: Synthetic oligonucleotide
gcccugcagcccccagaacc

SEQ ID NO: 870 - RNA, 20 nt, Artificial Sequence
  Description of Artificial Sequence: Synthetic oligonucleotide
cucacccgcagugacacaca

SEQ ID NO: 871 - RNA, 20 nt, Artificial Sequence
  Description of Artificial Sequence: Synthetic oligonucleotide
gucccuguggaacagcagca

SEQ ID NO: 872 - RNA, 20 nt, Artificial Sequence
  Description of Artificial Sequence: Synthetic oligonucleotide
guggguucaaguucggaugg

SEQ ID NO: 873 - RNA, 20 nt, Artificial Sequence
  Description of Artificial Sequence: Synthetic oligonucleotide
gccccaccugggucugagcu

SEQ ID NO: 874 - RNA, 20 nt, Artificial Sequence
  Description of Artificial Sequence: Synthetic oligonucleotide
ggccccaccugggucugagc

SEQ ID NO: 875 - RNA, 20 nt, Artificial Sequence
  Description of Artificial Sequence: Synthetic oligonucleotide
ccaccugggucugagcuggg

SEQ ID NO: 876 - RNA, 20 nt, Artificial Sequence
  Description of Artificial Sequence: Synthetic oligonucleotide
aggccucccaggagcccuca

SEQ ID NO: 877 - RNA, 20 nt, Artificial Sequence
  Description of Artificial Sequence: Synthetic oligonucleotide
cucccaggagcccucaggga

SEQ ID NO: 878 - RNA, 20 nt, Artificial Sequence
  Description of Artificial Sequence: Synthetic oligonucleotide
cccccagcucacagucacca

SEQ ID NO: 879 - RNA, 20 nt, Artificial Sequence
  Description of Artificial Sequence: Synthetic oligonucleotide
ggucucaccggugcuuaugu

SEQ ID NO: 880 - RNA, 20 nt, Artificial Sequence
  Description of Artificial Sequence: Synthetic oligonucleotide
ugcugcgccgacauaagcac

SEQ ID NO: 881 - RNA, 20 nt, Artificial Sequence
  Description of Artificial Sequence: Synthetic oligonucleotide
ggcagggcugggagagagca

SEQ ID NO: 882 - RNA, 20 nt, Artificial Sequence
  Description of Artificial Sequence: Synthetic oligonucleotide
cgagagcacgagcaugggug

SEQ ID NO: 883 - RNA, 20 nt, Artificial Sequence
  Description of Artificial Sequence: Synthetic oligonucleotide
gagcacgagcaugggugagg

SEQ ID NO: 884 - RNA, 20 nt, Artificial Sequence
  Description of Artificial Sequence: Synthetic oligonucleotide
agcacgagcaugggugagga

SEQ ID NO: 885 - RNA, 20 nt, Artificial Sequence
  Description of Artificial Sequence: Synthetic oligonucleotide
gcacgagcaugggugaggag

SEQ ID NO: 886 - RNA, 20 nt, Artificial Sequence
  Description of Artificial Sequence: Synthetic oligonucleotide
cucacccaugcucgugcucu

SEQ ID NO: 887 - RNA, 20 nt, Artificial Sequence
  Description of Artificial Sequence: Synthetic oligonucleotide
ggugccugcgcgggggaagg

SEQ ID NO: 888 - RNA, 20 nt, Artificial Sequence
  Description of Artificial Sequence: Synthetic oligonucleotide
gugccugcgcgggggaagga

SEQ ID NO: 889 - RNA, 20 nt, Artificial Sequence
  Description of Artificial Sequence: Synthetic oligonucleotide
cuuggugccugcgcggggga

SEQ ID NO: 890 - RNA, 20 nt, Artificial Sequence
  Description of Artificial Sequence: Synthetic oligonucleotide
ggccccagggcccugccgcc

SEQ ID NO: 891 - RNA, 20 nt, Artificial Sequence
  Description of Artificial Sequence: Synthetic oligonucleotide
ucuacgcucaggcaggggag

SEQ ID NO: 892 - RNA, 20 nt, Artificial Sequence
  Description of Artificial Sequence: Synthetic oligonucleotide
ccaccaggacggccccccau

SEQ ID NO: 893 - RNA, 20 nt, Artificial Sequence
  Description of Artificial Sequence: Synthetic oligonucleotide
ggcccaggcggcagggcccu

SEQ ID NO: 894 - RNA, 20 nt, Artificial Sequence
  Description of Artificial Sequence: Synthetic oligonucleotide
acgacuggccagggcgccug

SEQ ID NO: 895 - RNA, 20 nt, Artificial Sequence
  Description of Artificial Sequence: Synthetic oligonucleotide
caccgcccagacgacuggcc

SEQ ID NO: 896 - RNA, 20 nt, Artificial Sequence
  Description of Artificial Sequence: Synthetic oligonucleotide
cuacaacugggcuggcggcc

SEQ ID NO: 897 - RNA, 20 nt, Artificial Sequence
  Description of Artificial Sequence: Synthetic oligonucleotide
caccuaccuaagaaccaucc

SEQ ID NO: 898 - RNA, 20 nt, Artificial Sequence
  Description of Artificial Sequence: Synthetic oligonucleotide
ggagucugagagauggagag

SEQ ID NO: 899 - RNA, 20 nt, Artificial Sequence
  Description of Artificial Sequence: Synthetic oligonucleotide
gugucacacaacugcccaac

SEQ ID NO: 900 - RNA, 20 nt, Artificial Sequence
  Description of Artificial Sequence: Synthetic oligonucleotide
agccggccaguuccaaaccc

SEQ ID NO: 901 - RNA, 20 nt, Artificial Sequence
  Description of Artificial Sequence: Synthetic oligonucleotide
caguuccaaacccugguggu

SEQ ID NO: 902 - RNA, 20 nt, Artificial Sequence
  Description of Artificial Sequence: Synthetic oligonucleotide
cggccaguuccaaacccugg

SEQ ID NO: 903 - RNA, 20 nt, Artificial Sequence
  Description of Artificial Sequence: Synthetic oligonucleotide
ggacccagacuagcagcacc

SEQ ID NO: 904 - RNA, 20 nt, Artificial Sequence
  Description of Artificial Sequence: Synthetic oligonucleotide
gacguuaccucgugcggccc

SEQ ID NO: 905 - RNA, 20 nt, Artificial Sequence
  Description of Artificial Sequence: Synthetic oligonucleotide
ucccugcagagaaacacacu

SEQ ID NO: 906 - RNA, 20 nt, Artificial Sequence
  Description of Artificial Sequence: Synthetic oligonucleotide
gagacucaccaggggcuggc

SEQ ID NO: 907 - RNA, 20 nt, Artificial Sequence
  Description of Artificial Sequence: Synthetic oligonucleotide
ccuccuucuuugaggagaaa

SEQ ID NO: 908 - RNA, 20 nt, Artificial Sequence
  Description of Artificial Sequence: Synthetic oligonucleotide
gggguuccagggccugucug

SEQ ID NO: 909 - RNA, 20 nt, Artificial Sequence
  Description of Artificial Sequence: Synthetic oligonucleotide
uucucucuggaagggcacaa

SEQ ID NO: 910 - RNA, 20 nt, Artificial Sequence
  Description of Artificial Sequence: Synthetic oligonucleotide
ccaguggcgagagaagaccc

SEQ ID NO: 911 - RNA, 20 nt, Artificial Sequence
  Description of Artificial Sequence: Synthetic oligonucleotide
ugcccagccacugaggccug

SEQ ID NO: 912 - RNA, 20 nt, Artificial Sequence
  Description of Artificial Sequence: Synthetic oligonucleotide
cgacuggccagggcgccugu

SEQ ID NO: 913 - RNA, 20 nt, Artificial Sequence
  Description of Artificial Sequence: Synthetic oligonucleotide
accgcccagacgacuggcca

SEQ ID NO: 914 - RNA, 20 nt, Artificial Sequence
  Description of Artificial Sequence: Synthetic oligonucleotide
guuucugcagccgcuuuggg

SEQ ID NO: 915 - RNA, 20 nt, Artificial Sequence
  Description of Artificial Sequence: Synthetic oligonucleotide
uuaccuggagccacccaaag

SEQ ID NO: 916 - RNA, 20 nt, Artificial Sequence
  Description of Artificial Sequence: Synthetic oligonucleotide
ucacuaggugagcaaaagag

SEQ ID NO: 917 - RNA, 20 nt, Artificial Sequence
  Description of Artificial Sequence: Synthetic oligonucleotide
gccucuccagccaggggcug

SEQ ID NO: 918 - RNA, 20 nt, Artificial Sequence
  Description of Artificial Sequence: Synthetic oligonucleotide
cuuggcagcaucagccagac

SEQ ID NO: 919 - RNA, 20 nt, Artificial Sequence
  Description of Artificial Sequence: Synthetic oligonucleotide
ccacugggcgggaaagagaa

SEQ ID NO: 920 - RNA, 20 nt, Artificial Sequence
  Description of Artificial Sequence: Synthetic oligonucleotide
acauacucgaggccuggccc

SEQ ID NO: 921 - RNA, 20 nt, Artificial Sequence
  Description of Artificial Sequence: Synthetic oligonucleotide
ccugcagccccgcguccagc

SEQ ID NO: 922 - RNA, 20 nt, Artificial Sequence
  Description of Artificial Sequence: Synthetic oligonucleotide
cgcguccagcuggaugagcg

SEQ ID NO: 923 - RNA, 20 nt, Artificial Sequence
  Description of Artificial Sequence: Synthetic oligonucleotide
ugggccaggccucgaguaug

SEQ ID NO: 924 - RNA, 20 nt, Artificial Sequence
  Description of Artificial Sequence: Synthetic oligonucleotide
gggaguuacccagaacagug

SEQ ID NO: 925 - RNA, 20 nt, Artificial Sequence
  Description of Artificial Sequence: Synthetic oligonucleotide
ccugccccaagucagcccca

SEQ ID NO: 926 - RNA, 20 nt, Artificial Sequence
  Description of Artificial Sequence: Synthetic oligonucleotide
gccagggccgagucccuguc

SEQ ID NO: 927 - RNA, 20 nt, Artificial Sequence
  Description of Artificial Sequence: Synthetic oligonucleotide
ccagggccgagucccugucc

SEQ ID NO: 928 - RNA, 20 nt, Artificial Sequence
  Description of Artificial Sequence: Synthetic oligonucleotide
gccccagggcccagagucca

SEQ ID NO: 929 - RNA, 20 nt, Artificial Sequence
  Description of Artificial Sequence: Synthetic oligonucleotide
augugagccaggcccaggcu

SEQ ID NO: 930 - RNA, 20 nt, Artificial Sequence
  Description of Artificial Sequence: Synthetic oligonucleotide
gaggaguccacuuggcagug

SEQ ID NO: 931 - RNA, 20 nt, Artificial Sequence
  Description of Artificial Sequence: Synthetic oligonucleotide
gagucacugaaaagaguaga

SEQ ID NO: 932 - RNA, 20 nt, Artificial Sequence
  Description of Artificial Sequence: Synthetic oligonucleotide
cuggacaagaacgcuuugug

SEQ ID NO: 933 - RNA, 20 nt, Artificial Sequence
  Description of Artificial Sequence: Synthetic oligonucleotide
ccaucccagaggaguuucuc

SEQ ID NO: 934 - RNA, 20 nt, Artificial Sequence
  Description of Artificial Sequence: Synthetic oligonucleotide
uggcaaugccagcuguacca

SEQ ID NO: 935 - RNA, 20 nt, Artificial Sequence
  Description of Artificial Sequence: Synthetic oligonucleotide
uaccagggggagaggcuucu

SEQ ID NO: 936 - RNA, 20 nt, Artificial Sequence
  Description of Artificial Sequence: Synthetic oligonucleotide
ggcauugccaaggcugggaa

SEQ ID NO: 937 - RNA, 20 nt, Artificial Sequence
  Description of Artificial Sequence: Synthetic oligonucleotide
ggcaccuauggagaaaguac

SEQ ID NO: 938 - RNA, 20 nt, Artificial Sequence
  Description of Artificial Sequence: Synthetic oligonucleotide
agacaggugagccagggaca

SEQ ID NO: 939 - RNA, 20 nt, Artificial Sequence
  Description of Artificial Sequence: Synthetic oligonucleotide
ggcucaccugucuucuccaa

SEQ ID NO: 940 - RNA, 20 nt, Artificial Sequence
  Description of Artificial Sequence: Synthetic oligonucleotide
gucgccacugugagaagaga

SEQ ID NO: 941 - RNA, 20 nt, Artificial Sequence
  Description of Artificial Sequence: Synthetic oligonucleotide
gcaggcucagagcaagauag

SEQ ID NO: 942 - RNA, 20 nt, Artificial Sequence
  Description of Artificial Sequence: Synthetic oligonucleotide
gcuggagcaagaaccggagc

SEQ ID NO: 943 - RNA, 20 nt, Artificial Sequence
  Description of Artificial Sequence: Synthetic oligonucleotide
acucaccuuugcagaagaca

SEQ ID NO: 944 - RNA, 20 nt, Artificial Sequence
  Description of Artificial Sequence: Synthetic oligonucleotide
cacucaccuuugcagaagac

SEQ ID NO: 945 - RNA, 20 nt, Artificial Sequence
  Description of Artificial Sequence: Synthetic oligonucleotide
agggccagguccugguagcc

SEQ ID NO: 946 - RNA, 20 nt, Artificial Sequence
  Description of Artificial Sequence: Synthetic oligonucleotide
ggcccagccugcugugguac

SEQ ID NO: 947 - RNA, 20 nt, Artificial Sequence
  Description of Artificial Sequence: Synthetic oligonucleotide
gcuucggcaggcugacagcc

SEQ ID NO: 948 - RNA, 20 nt, Artificial Sequence
  Description of Artificial Sequence: Synthetic oligonucleotide
uauccaaggacugagggcca

SEQ ID NO: 949 - RNA, 20 nt, Artificial Sequence
  Description of Artificial Sequence: Synthetic oligonucleotide
ggaacccagauuuauguaau

SEQ ID NO: 950 - RNA, 20 nt, Artificial Sequence
  Description of Artificial Sequence: Synthetic oligonucleotide
gcucaccaauuacauaaauc

SEQ ID NO: 951 - RNA, 20 nt, Artificial Sequence
  Description of Artificial Sequence: Synthetic oligonucleotide
cucaccaauuacauaaaucu

SEQ ID NO: 952 - RNA, 20 nt, Artificial Sequence
  Description of Artificial Sequence: Synthetic oligonucleotide
cucagcugaaccuggcuacc

SEQ ID NO: 953 - RNA, 20 nt, Artificial Sequence
  Description of Artificial Sequence: Synthetic oligonucleotide
ggcgucucaaacagguaucu

SEQ ID NO: 954 - RNA, 20 nt, Artificial Sequence
  Description of Artificial Sequence: Synthetic oligonucleotide
caaagccugaagagaaaucc

SEQ ID NO: 955 - RNA, 20 nt, Artificial Sequence
  Description of Artificial Sequence: Synthetic oligonucleotide
agagccugaaggagaagucu

SEQ ID NO: 956 - RNA, 20 nt, Artificial Sequence
  Description of Artificial Sequence: Synthetic oligonucleotide
ucccaguaccgggaaggcga

SEQ ID NO: 957 - RNA, 20 nt, Artificial Sequence
  Description of Artificial Sequence: Synthetic oligonucleotide
gguuccuguggagcacaggg

SEQ ID NO: 958 - RNA, 20 nt, Artificial Sequence
  Description of Artificial Sequence: Synthetic oligonucleotide
ugggguuccuguggagcaca

SEQ ID NO: 959 - RNA, 20 nt, Artificial Sequence
  Description of Artificial Sequence: Synthetic oligonucleotide
ucauuuccuagaugggagac

SEQ ID NO: 960 - RNA, 20 nt, Artificial Sequence
  Description of Artificial Sequence: Synthetic oligonucleotide
uuccuagaugggagacaggc

SEQ ID NO: 961 - RNA, 20 nt, Artificial Sequence
  Description of Artificial Sequence: Synthetic oligonucleotide
ccaggugucugaggaggaag

SEQ ID NO: 962 - RNA, 20 nt, Artificial Sequence
  Description of Artificial Sequence: Synthetic oligonucleotide
gugucugaggaggaagggga

SEQ ID NO: 963 - RNA, 20 nt, Artificial Sequence
  Description of Artificial Sequence: Synthetic oligonucleotide
uaguccugggugggguaggg

SEQ ID NO: 964 - RNA, 20 nt, Artificial Sequence
  Description of Artificial Sequence: Synthetic oligonucleotide
aguccugggugggguagggu

SEQ ID NO: 965 - RNA, 20 nt, Artificial Sequence
  Description of Artificial Sequence: Synthetic oligonucleotide
cauuaccucauaguaggcaa

SEQ ID NO: 966 - RNA, 20 nt, Artificial Sequence
  Description of Artificial Sequence: Synthetic oligonucleotide
ccauuaccucauaguaggca

SEQ ID NO: 967 - RNA, 20 nt, Artificial Sequence
  Description of Artificial Sequence: Synthetic oligonucleotide
acagaucugagcagauaaca

SEQ ID NO: 968 - RNA, 20 nt, Artificial Sequence
  Description of Artificial Sequence: Synthetic oligonucleotide
uccuacccacugguugcccu

SEQ ID NO: 969 - RNA, 20 nt, Artificial Sequence
  Description of Artificial Sequence: Synthetic oligonucleotide
aggugcaguaccugaaggac

SEQ ID NO: 970 - RNA, 20 nt, Artificial Sequence
  Description of Artificial Sequence: Synthetic oligonucleotide
caggcagcuggcgggcgcca

SEQ ID NO: 971 - RNA, 20 nt, Artificial Sequence
  Description of Artificial Sequence: Synthetic oligonucleotide
gacuuccagggcuccuucug

SEQ ID NO: 972 - RNA, 20 nt, Artificial Sequence
  Description of Artificial Sequence: Synthetic oligonucleotide
cauccagauacauuuuguca

SEQ ID NO: 973 - RNA, 20 nt, Artificial Sequence
  Description of Artificial Sequence: Synthetic oligonucleotide
accugccaaacacagacagu

SEQ ID NO: 974 - RNA, 20 nt, Artificial Sequence
  Description of Artificial Sequence: Synthetic oligonucleotide
cgugcagaugcaauggucca

SEQ ID NO: 975 - RNA, 20 nt, Artificial Sequence
  Description of Artificial Sequence: Synthetic oligonucleotide
uguaacuguaacaaaacaua

SEQ ID NO: 976 - RNA, 20 nt, Artificial Sequence
  Description of Artificial Sequence: Synthetic oligonucleotide
acuuaccaccgaccaugcau

SEQ ID NO: 977 - RNA, 20 nt, Artificial Sequence
  Description of Artificial Sequence: Synthetic oligonucleotide
cuuaccaaaaaccuugacug

SEQ ID NO: 978 - RNA, 20 nt, Artificial Sequence
  Description of Artificial Sequence: Synthetic oligonucleotide
ccaguccaaaucuucgauga

SEQ ID NO: 979 - RNA, 20 nt, Artificial Sequence
  Description of Artificial Sequence: Synthetic oligonucleotide
caguccaaaucuucgaugau

SEQ ID NO: 980 - RNA, 20 nt, Artificial Sequence
  Description of Artificial Sequence: Synthetic oligonucleotide
aaaccaugugauauuugcuu

SEQ ID NO: 981 - RNA, 20 nt, Artificial Sequence
  Description of Artificial Sequence: Synthetic oligonucleotide
auguuccacacuuuauuucc

SEQ ID NO: 982 - RNA, 20 nt, Artificial Sequence
  Description of Artificial Sequence: Synthetic oligonucleotide
ucacguugaggagugguguu

SEQ ID NO: 983 - RNA, 20 nt, Artificial Sequence
  Description of Artificial Sequence: Synthetic oligonucleotide
cauugucuagggauauaaag

SEQ ID NO: 984 - RNA, 20 nt, Artificial Sequence
  Description of Artificial Sequence: Synthetic oligonucleotide
acauugucuagggauauaaa

SEQ ID NO: 985 - RNA, 20 nt, Artificial Sequence
  Description of Artificial Sequence: Synthetic oligonucleotide
gacauugucuagggauauaa

SEQ ID NO: 986 - RNA, 20 nt, Artificial Sequence
  Description of Artificial Sequence: Synthetic oligonucleotide
uggccaggacauuccaucuu

SEQ ID NO: 987 - RNA, 20 nt, Artificial Sequence
  Description of Artificial Sequence: Synthetic oligonucleotide
ccauucuaggaacaaaauau

SEQ ID NO: 988 - RNA, 20 nt, Artificial Sequence
  Description of Artificial Sequence: Synthetic oligonucleotide
gagcuuccaagucuucucca

SEQ ID NO: 989 - RNA, 20 nt, Artificial Sequence
  Description of Artificial Sequence: Synthetic oligonucleotide
uccccgaaaaggucgaauuu

SEQ ID NO: 990 - RNA, 20 nt, Artificial Sequence
  Description of Artificial Sequence: Synthetic oligonucleotide
augaagaacagucacaggac

SEQ ID NO: 991 - RNA, 20 nt, Artificial Sequence
  Description of Artificial Sequence: Synthetic oligonucleotide
gauuucgucuguaggcacaa

SEQ ID NO: 992 - RNA, 20 nt, Artificial Sequence
  Description of Artificial Sequence: Synthetic oligonucleotide
uaaacuuaccugaaacagcc

SEQ ID NO: 993 - RNA, 20 nt, Artificial Sequence
  Description of Artificial Sequence: Synthetic oligonucleotide
auucagacagugccuucaug

SEQ ID NO: 994 - RNA, 20 nt, Artificial Sequence
  Description of Artificial Sequence: Synthetic oligonucleotide
guugcacucgauugggacag

SEQ ID NO: 995 - RNA, 20 nt, Artificial Sequence
  Description of Artificial Sequence: Synthetic oligonucleotide
uuauuucaagcccugauuga

SEQ ID NO: 996 - RNA, 20 nt, Artificial Sequence
  Description of Artificial Sequence: Synthetic oligonucleotide
uuaccuguguaacuuuuaua

SEQ ID NO: 997 - RNA, 20 nt, Artificial Sequence
  Description of Artificial Sequence: Synthetic oligonucleotide
auuguuccuggaauuugggg

SEQ ID NO: 998 - RNA, 20 nt, Artificial Sequence
  Description of Artificial Sequence: Synthetic oligonucleotide
auuauaccugccaugccgua

SEQ ID NO: 999 - RNA, 20 nt, Artificial Sequence
  Description of Artificial Sequence: Synthetic oligonucleotide
guuccuggaauuuggggagg

SEQ ID NO: 1000 - RNA, 20 nt, Artificial Sequence
  Description of Artificial Sequence: Synthetic oligonucleotide
cugccaugccguaaggcaag

SEQ ID NO: 1001 - RNA, 20 nt, Artificial Sequence
  Description of Artificial Sequence: Synthetic oligonucleotide
ucuaccuuuggugaacccgu

SEQ ID NO: 1002 - RNA, 20 nt, Artificial Sequence
  Description of Artificial Sequence: Synthetic oligonucleotide
cuuaccuuagcuccuucuaa

SEQ ID NO: 1003 - RNA, 20 nt, Artificial Sequence
  Description of Artificial Sequence: Synthetic oligonucleotide
gggaugucgacuccuagggg

SEQ ID NO: 1004 - RNA, 20 nt, Artificial Sequence
  Description of Artificial Sequence: Synthetic oligonucleotide
cgagggcaccaugcuucaag

SEQ ID NO: 1005 - RNA, 20 nt, Artificial Sequence
  Description of Artificial Sequence: Synthetic oligonucleotide
aaacucacuuuaugcuaggg

SEQ ID NO: 1006 - RNA, 20 nt, Artificial Sequence
  Description of Artificial Sequence: Synthetic oligonucleotide
cucacuuuaugcuagggagg

SEQ ID NO: 1007 - RNA, 20 nt, Artificial Sequence
  Description of Artificial Sequence: Synthetic oligonucleotide
cuucaccugcauuuaaagaa

SEQ ID NO: 1008 - RNA, 20 nt, Artificial Sequence
  Description of Artificial Sequence: Synthetic oligonucleotide
ccaccagauuagcucuggcc

SEQ ID NO: 1009 - RNA, 20 nt, Artificial Sequence
  Description of Artificial Sequence: Synthetic oligonucleotide
cuaccuuuggugaacccguu

SEQ ID NO: 1010 - RNA, 20 nt, Artificial Sequence
  Description of Artificial Sequence: Synthetic oligonucleotide
auguuccagauguccagaua

SEQ ID NO: 1011 - RNA, 20 nt, Artificial Sequence
  Description of Artificial Sequence: Synthetic oligonucleotide
uguuccagauguccagauau

SEQ ID NO: 1012 - RNA, 20 nt, Artificial Sequence
  Description of Artificial Sequence: Synthetic oligonucleotide
agauagacaaacaaguugga

SEQ ID NO: 1013 - RNA, 20 nt, Artificial Sequence
  Description of Artificial Sequence: Synthetic oligonucleotide
agcuugcaccaagucacaug

SEQ ID NO: 1014 - RNA, 20 nt, Artificial Sequence
  Description of Artificial Sequence: Synthetic oligonucleotide
acccaccuuggugccuucuc

SEQ ID NO: 1015 - RNA, 20 nt, Artificial Sequence
  Description of Artificial Sequence: Synthetic oligonucleotide
acucacgcuggauagccucc

SEQ ID NO: 1016 - RNA, 20 nt, Artificial Sequence
  Description of Artificial Sequence: Synthetic oligonucleotide
uggaguaccugaggaauauc

SEQ ID NO: 1017 - RNA, 20 nt, Artificial Sequence
  Description of Artificial Sequence: Synthetic oligonucleotide
uuaccccacuuaacuaucuu

SEQ ID NO: 1018 - RNA, 20 nt, Artificial Sequence
  Description of Artificial Sequence: Synthetic oligonucleotide
ucgaucuaugaaaaagacag

SEQ ID NO: 1019 - RNA, 18 nt, Artificial Sequence
  Description of Artificial Sequence: Synthetic oligonucleotide
uaccccacuuaacuaucu

SEQ ID NO: 1020 - RNA, 20 nt, Artificial Sequence
  Description of Artificial Sequence: Synthetic oligonucleotide
cucagguacuccaaagauuc

SEQ ID NO: 1021 - RNA, 20 nt, Artificial Sequence
  Description of Artificial Sequence: Synthetic oligonucleotide
cuuaccccacuuaacuaucu

SEQ ID NO: 1022 - RNA, 20 nt, Artificial Sequence
  Description of Artificial Sequence: Synthetic oligonucleotide
cauuugccagacagaaccuc

SEQ ID NO: 1023 - RNA, 20 nt, Artificial Sequence
  Description of Artificial Sequence: Synthetic oligonucleotide
aaacaagaccaaaaggcuaa

SEQ ID NO: 1024 - RNA, 20 nt, Artificial Sequence
  Description of Artificial Sequence: Synthetic oligonucleotide
guaagccaagaaagaaaucc

SEQ ID NO: 1025 - RNA, 20 nt, Artificial Sequence
  Description of Artificial Sequence: Synthetic oligonucleotide
gcuucagauucugaaugagc

SEQ ID NO: 1026 - RNA, 20 nt, Artificial Sequence
  Description of Artificial Sequence: Synthetic oligonucleotide
uuaaaacaaaaugaaaugaa

SEQ ID NO: 1027 - RNA, 20 nt, Artificial Sequence
  Description of Artificial Sequence: Synthetic oligonucleotide
guuccucagcuuccuucaga

SEQ ID NO: 1028 - RNA, 20 nt, Artificial Sequence
  Description of Artificial Sequence: Synthetic oligonucleotide
caaagagcaagagauucuga

SEQ ID NO: 1029 - RNA, 20 nt, Artificial Sequence
  Description of Artificial Sequence: Synthetic oligonucleotide
aaagagcaagagauucugaa

SEQ ID NO: 1030 - RNA, 20 nt, Artificial Sequence
  Description of Artificial Sequence: Synthetic oligonucleotide
acacagcacuaucugaaacc

SEQ ID NO: 1031 - RNA, 20 nt, Artificial Sequence
  Description of Artificial Sequence: Synthetic oligonucleotide
uaccaaguugaaaugaauca

SEQ ID NO: 1032 - RNA, 20 nt, Artificial Sequence
  Description of Artificial Sequence: Synthetic oligonucleotide
augaaucaagggcaguccca

SEQ ID NO: 1033 - RNA, 20 nt, Artificial Sequence
  Description of Artificial Sequence: Synthetic oligonucleotide
agggcagucccaagguacag

SEQ ID NO: 1034 - RNA, 20 nt, Artificial Sequence
  Description of Artificial Sequence: Synthetic oligonucleotide
guuccaaaaacccucacacc

SEQ ID NO: 1035 - RNA, 20 nt, Artificial Sequence
  Description of Artificial Sequence: Synthetic oligonucleotide
gaaacagcacuugaaucaac

SEQ ID NO: 1036 - RNA, 20 nt, Artificial Sequence
  Description of Artificial Sequence: Synthetic oligonucleotide
auuacaaauaaagaauaaag

SEQ ID NO: 1037 - RNA, 20 nt, Artificial Sequence
  Description of Artificial Sequence: Synthetic oligonucleotide
uaauguccaaaugggacugg

SEQ ID NO: 1038 - RNA, 20 nt, Artificial Sequence
  Description of Artificial Sequence: Synthetic oligonucleotide
caaagcaagaucuucuucac

SEQ ID NO: 1039 - RNA, 20 nt, Artificial Sequence
  Description of Artificial Sequence: Synthetic oligonucleotide
acaacaagcuucaguucuac

SEQ ID NO: 1040 - RNA, 20 nt, Artificial Sequence
  Description of Artificial Sequence: Synthetic oligonucleotide
cugcgcaacuugcucagcaa

SEQ ID NO: 1041 - RNA, 20 nt, Artificial Sequence
  Description of Artificial Sequence: Synthetic oligonucleotide
cacucagaccccuccccaga

SEQ ID NO: 1042 - RNA, 20 nt, Artificial Sequence
  Description of Artificial Sequence: Synthetic oligonucleotide
uuuuuccauguuuuguuuuc

SEQ ID NO: 1043 - RNA, 20 nt, Artificial Sequence
  Description of Artificial Sequence: Synthetic oligonucleotide
uuaccuacacaucugcaaga

SEQ ID NO: 1044 - RNA, 20 nt, Artificial Sequence
  Description of Artificial Sequence: Synthetic oligonucleotide
acacuuacccacuuagcaau

SEQ ID NO: 1045 - RNA, 20 nt, Artificial Sequence
  Description of Artificial Sequence: Synthetic oligonucleotide
caugcagaauggcagcacau

SEQ ID NO: 1046 - RNA, 20 nt, Artificial Sequence
  Description of Artificial Sequence: Synthetic oligonucleotide
aagcucaggaggagaaaaaa

SEQ ID NO: 1047 - RNA, 20 nt, Artificial Sequence
  Description of Artificial Sequence: Synthetic oligonucleotide
cgcaagccaggcuaaacagu

SEQ ID NO: 1048 - RNA, 20 nt, Artificial Sequence
  Description of Artificial Sequence: Synthetic oligonucleotide
uucuccccagucucagccga

SEQ ID NO: 1049 - RNA, 20 nt, Artificial Sequence
  Description of Artificial Sequence: Synthetic oligonucleotide
uggucaggaaaagcagccau

SEQ ID NO: 1050 - RNA, 20 nt, Artificial Sequence
  Description of Artificial Sequence: Synthetic oligonucleotide
cuaguccaggguguggcuuc

SEQ ID NO: 1051 - RNA, 20 nt, Artificial Sequence
  Description of Artificial Sequence: Synthetic oligonucleotide
ccccaaaaucaacauggcag

SEQ ID NO: 1052 - RNA, 20 nt, Artificial Sequence
  Description of Artificial Sequence: Synthetic oligonucleotide
ugugauccagcagccuucuu

SEQ ID NO: 1053 - RNA, 20 nt, Artificial Sequence
  Description of Artificial Sequence: Synthetic oligonucleotide
gaccagaucaaggccauaag

SEQ ID NO: 1054 - RNA, 20 nt, Artificial Sequence
  Description of Artificial Sequence: Synthetic oligonucleotide
caagacaagaaaagcaugaa

SEQ ID NO: 1055 - RNA, 20 nt, Artificial Sequence
  Description of Artificial Sequence: Synthetic oligonucleotide
cugaacagggacuguuagga

SEQ ID NO: 1056 - RNA, 20 nt, Artificial Sequence
  Description of Artificial Sequence: Synthetic oligonucleotide
ccagagcucagaguggcaac

SEQ ID NO: 1057 - RNA, 20 nt, Artificial Sequence
  Description of Artificial Sequence: Synthetic oligonucleotide
uugcugcagacgccccguga

SEQ ID NO: 1058 - RNA, 20 nt, Artificial Sequence
  Description of Artificial Sequence: Synthetic oligonucleotide
cugcagacgccccgugacgg

SEQ ID NO: 1059 - RNA, 20 nt, Artificial Sequence
  Description of Artificial Sequence: Synthetic oligonucleotide
cgacaagcagugccuuugcu

SEQ ID NO: 1060 - RNA, 20 nt, Artificial Sequence
  Description of Artificial Sequence: Synthetic oligonucleotide
gcccagaacgugauugacua

SEQ ID NO: 1061 - RNA, 20 nt, Artificial Sequence
  Description of Artificial Sequence: Synthetic oligonucleotide
ugugccagggguguuaugac

SEQ ID NO: 1062 - RNA, 20 nt, Artificial Sequence
  Description of Artificial Sequence: Synthetic oligonucleotide
cagauccagucugauggcag

SEQ ID NO: 1063 - RNA, 20 nt, Artificial Sequence
  Description of Artificial Sequence: Synthetic oligonucleotide
uguacacgauggucagccau

SEQ ID NO: 1064 - RNA, 20 nt, Artificial Sequence
  Description of Artificial Sequence: Synthetic oligonucleotide
uuuuaccuuggggcucugac

SEQ ID NO: 1065 - RNA, 20 nt, Artificial Sequence
  Description of Artificial Sequence: Synthetic oligonucleotide
agccccaagguaaaaaggcc

SEQ ID NO: 1066 - RNA, 20 nt, Artificial Sequence
  Description of Artificial Sequence: Synthetic oligonucleotide
gagccccaagguaaaaaggc

SEQ ID NO: 1067 - RNA, 20 nt, Artificial Sequence
  Description of Artificial Sequence: Synthetic oligonucleotide
cagcucacagugugccacca

SEQ ID NO: 1068 - RNA, 20 nt, Artificial Sequence
  Description of Artificial Sequence: Synthetic oligonucleotide
uaugaccagauggaccuggc

SEQ ID NO: 1069 - RNA, 20 nt, Artificial Sequence
  Description of Artificial Sequence: Synthetic oligonucleotide
acuggaccaguaugucuucc

SEQ ID NO: 1070 - RNA, 20 nt, Artificial Sequence
  Description of Artificial Sequence: Synthetic oligonucleotide
ugucuuccaggacucccagc

SEQ ID NO: 1071 - RNA, 20 nt, Artificial Sequence
  Description of Artificial Sequence: Synthetic oligonucleotide
uucaaccaggagccagccuc

SEQ ID NO: 1072 - RNA, 20 nt, Artificial Sequence
  Description of Artificial Sequence: Synthetic oligonucleotide
gaccagauucccaguauguu

SEQ ID NO: 1073 - RNA, 20 nt, Artificial Sequence
  Description of Artificial Sequence: Synthetic oligonucleotide
uaacauacugggaaucuggu

SEQ ID NO: 1074 - RNA, 20 nt, Artificial Sequence
  Description of Artificial Sequence: Synthetic oligonucleotide
aaaggcacugcaagagacaa

SEQ ID NO: 1075 - RNA, 20 nt, Artificial Sequence
  Description of Artificial Sequence: Synthetic oligonucleotide
cucuggcaaaucucugaggc

SEQ ID NO: 1076 - RNA, 20 nt, Artificial Sequence
  Description of Artificial Sequence: Synthetic oligonucleotide
agccaaguacccccucccag

SEQ ID NO: 1077 - RNA, 20 nt, Artificial Sequence
  Description of Artificial Sequence: Synthetic oligonucleotide
accucccgagcaaacaugac

SEQ ID NO: 1078 - RNA, 20 nt, Artificial Sequence
  Description of Artificial Sequence: Synthetic oligonucleotide
ccuuaccugucauguuugcu

SEQ ID NO: 1079 - RNA, 20 nt, Artificial Sequence
  Description of Artificial Sequence: Synthetic oligonucleotide
ugcucuggagauggagaagc

SEQ ID NO: 1080 - RNA, 20 nt, Artificial Sequence
  Description of Artificial Sequence: Synthetic oligonucleotide
cccacccaaugcccggcagc

SEQ ID NO: 1081 - RNA, 20 nt, Artificial Sequence
  Description of Artificial Sequence: Synthetic oligonucleotide
aggccauuuuggaagcuugu

SEQ ID NO: 1082 - RNA, 20 nt, Artificial Sequence
  Description of Artificial Sequence: Synthetic oligonucleotide
accggcucugcaaaggccag

SEQ ID NO: 1083 - RNA, 20 nt, Artificial Sequence
  Description of Artificial Sequence: Synthetic oligonucleotide
uggugcaggccaggcuggag

SEQ ID NO: 1084 - RNA, 20 nt, Artificial Sequence
  Description of Artificial Sequence: Synthetic oligonucleotide
gaacggcagcuggcccaagg

SEQ ID NO: 1085 - RNA, 20 nt, Artificial Sequence
  Description of Artificial Sequence: Synthetic oligonucleotide
ggcccaaggaggccuggcug

SEQ ID NO: 1086 - RNA, 20 nt, Artificial Sequence
  Description of Artificial Sequence: Synthetic oligonucleotide
gacacgagugauugcugugc

SEQ ID NO: 1087 - RNA, 20 nt, Artificial Sequence
  Description of Artificial Sequence: Synthetic oligonucleotide
cuggucagggcaagagcuau

SEQ ID NO: 1088 - RNA, 20 nt, Artificial Sequence
  Description of Artificial Sequence: Synthetic oligonucleotide
gggcccacagccacucgugg

SEQ ID NO: 1089 - RNA, 20 nt, Artificial Sequence
  Description of Artificial Sequence: Synthetic oligonucleotide
uuccagaagaagcugcuccg

SEQ ID NO: 1090 - RNA, 20 nt, Artificial Sequence
  Description of Artificial Sequence: Synthetic oligonucleotide
ccugguccagagccugagca

SEQ ID NO: 1091 - RNA, 20 nt, Artificial Sequence
  Description of Artificial Sequence: Synthetic oligonucleotide
cagacaucaaaguacccuac

SEQ ID NO: 1092 - RNA, 20 nt, Artificial Sequence
  Description of Artificial Sequence: Synthetic oligonucleotide
acaucaaaguacccuacagg

SEQ ID NO: 1093 - RNA, 20 nt, Artificial Sequence
  Description of Artificial Sequence: Synthetic oligonucleotide
cgcccagguccucacgucug

SEQ ID NO: 1094 - RNA, 20 nt, Artificial Sequence
  Description of Artificial Sequence: Synthetic oligonucleotide
cuuaguccaacacccaccgc

SEQ ID NO: 1095 - RNA, 20 nt, Artificial Sequence
  Description of Artificial Sequence: Synthetic oligonucleotide
ccuccugcaaugcuuccugg

SEQ ID NO: 1096 - RNA, 20 nt, Artificial Sequence
  Description of Artificial Sequence: Synthetic oligonucleotide
ggaagcagaaggugcuugcg

SEQ ID NO: 1097 - RNA, 20 nt, Artificial Sequence
  Description of Artificial Sequence: Synthetic oligonucleotide
ggcugcagccggggacacug

SEQ ID NO: 1098 - RNA, 20 nt, Artificial Sequence
  Description of Artificial Sequence: Synthetic oligonucleotide
cugccaaauuccagccuccu

SEQ ID NO: 1099 - RNA, 20 nt, Artificial Sequence
  Description of Artificial Sequence: Synthetic oligonucleotide
ggcgggccaagacuucuccc

SEQ ID NO: 1100 - RNA, 20 nt, Artificial Sequence
  Description of Artificial Sequence: Synthetic oligonucleotide
agacucagaggugagaggag

SEQ ID NO: 1101 - RNA, 20 nt, Artificial Sequence
  Description of Artificial Sequence: Synthetic oligonucleotide
agccuaggaggcaaagagca

SEQ ID NO: 1102 - RNA, 20 nt, Artificial Sequence
  Description of Artificial Sequence: Synthetic oligonucleotide
cccccaggcuuuccccaaac

SEQ ID NO: 1103 - RNA, 20 nt, Artificial Sequence
  Description of Artificial Sequence: Synthetic oligonucleotide
ucacuccagaugcugcaggg

SEQ ID NO: 1104 - RNA, 20 nt, Artificial Sequence
  Description of Artificial Sequence: Synthetic oligonucleotide
aggcugcagguggaaucaga

SEQ ID NO: 1105 - RNA, 20 nt, Artificial Sequence
  Description of Artificial Sequence: Synthetic oligonucleotide
cuucccccagcugaaguccu

SEQ ID NO: 1106 - RNA, 20 nt, Artificial Sequence
  Description of Artificial Sequence: Synthetic oligonucleotide
cacucacuugaggguuucca

SEQ ID NO: 1107 - RNA, 20 nt, Artificial Sequence
  Description of Artificial Sequence: Synthetic oligonucleotide
cagacugcggggacacagug

SEQ ID NO: 1108 - RNA, 20 nt, Artificial Sequence
  Description of Artificial Sequence: Synthetic oligonucleotide
ccacucaccuuagccugagc

SEQ ID NO: 1109 - RNA, 20 nt, Artificial Sequence
  Description of Artificial Sequence: Synthetic oligonucleotide
cacucaccuuagccugagca

SEQ ID NO: 1110 - RNA, 20 nt, Artificial Sequence
  Description of Artificial Sequence: Synthetic oligonucleotide
guacaagcugucggaaacag

SEQ ID NO: 1111 - RNA, 20 nt, Artificial Sequence
  Description of Artificial Sequence: Synthetic oligonucleotide
acacucacuccaucacccgg

SEQ ID NO: 1112 - RNA, 20 nt, Artificial Sequence
  Description of Artificial Sequence: Synthetic oligonucleotide
cacucacuccaucacccgga

SEQ ID NO: 1113 - RNA, 20 nt, Artificial Sequence
  Description of Artificial Sequence: Synthetic oligonucleotide
cguccaguacaacaaguuca

SEQ ID NO: 1114 - RNA, 20 nt, Artificial Sequence
  Description of Artificial Sequence: Synthetic oligonucleotide
ccacauccugcaagggggga

SEQ ID NO: 1115 - RNA, 20 nt, Artificial Sequence
  Description of Artificial Sequence: Synthetic oligonucleotide
cacauccugcaaggggggau

SEQ ID NO: 1116 - RNA, 20 nt, Artificial Sequence
  Description of Artificial Sequence: Synthetic oligonucleotide
ugggcguccacauccugcaa

SEQ ID NO: 1117 - RNA, 20 nt, Artificial Sequence
  Description of Artificial Sequence: Synthetic oligonucleotide
gggcguccacauccugcaag

SEQ ID NO: 1118 - RNA, 20 nt, Artificial Sequence
  Description of Artificial Sequence: Synthetic oligonucleotide
ggcguccacauccugcaagg

SEQ ID NO: 1119 - RNA, 20 nt, Artificial Sequence
  Description of Artificial Sequence: Synthetic oligonucleotide
gcguccacauccugcaaggg

SEQ ID NO: 1120 - RNA, 20 nt, Artificial Sequence
  Description of Artificial Sequence: Synthetic oligonucleotide
gcccaagguaagagcuuccc

SEQ ID NO: 1121 - RNA, 20 nt, Artificial Sequence
  Description of Artificial Sequence: Synthetic oligonucleotide
gcucuuaccuugggcagcca

SEQ ID NO: 1122 - RNA, 20 nt, Artificial Sequence
  Description of Artificial Sequence: Synthetic oligonucleotide
agcucuuaccuugggcagcc

SEQ ID NO: 1123 - RNA, 20 nt, Artificial Sequence
  Description of Artificial Sequence: Synthetic oligonucleotide
ugcaccucuggggaggaccu

SEQ ID NO: 1124 - RNA, 20 nt, Artificial Sequence
  Description of Artificial Sequence: Synthetic oligonucleotide
cugcaccucuggggaggacc

SEQ ID NO: 1125 - RNA, 20 nt, Artificial Sequence
  Description of Artificial Sequence: Synthetic oligonucleotide
cgccugcagcugucggacac

SEQ ID NO: 1126 - RNA, 20 nt, Artificial Sequence
  Description of Artificial Sequence: Synthetic oligonucleotide
caccugccaggccaucacgg

SEQ ID NO: 1127 - RNA, 20 nt, Artificial Sequence
  Description of Artificial Sequence: Synthetic oligonucleotide
cccuaccugucaccaggacc

SEQ ID NO: 1128 - RNA, 20 nt, Artificial Sequence
  Description of Artificial Sequence: Synthetic oligonucleotide
ccuaccugucaccaggacca

SEQ ID NO: 1129 - RNA, 20 nt, Artificial Sequence
  Description of Artificial Sequence: Synthetic oligonucleotide
ccucugagaaggaaaaaaga

SEQ ID NO: 1130 - RNA, 20 nt, Artificial Sequence
  Description of Artificial Sequence: Synthetic oligonucleotide
cagaggaacagucccaagga

SEQ ID NO: 1131 - RNA, 20 nt, Artificial Sequence
  Description of Artificial Sequence: Synthetic oligonucleotide
cacucaccugcccacagcag

SEQ ID NO: 1132 - RNA, 20 nt, Artificial Sequence
  Description of Artificial Sequence: Synthetic oligonucleotide
ccacucaccugcccacagca

SEQ ID NO: 1133 - RNA, 20 nt, Artificial Sequence
  Description of Artificial Sequence: Synthetic oligonucleotide
gccacucaccugcccacagc

SEQ ID NO: 1134 - RNA, 20 nt, Artificial Sequence
  Description of Artificial Sequence: Synthetic oligonucleotide
agggccccuguggggaaacg

SEQ ID NO: 1135 - RNA, 20 nt, Artificial Sequence
  Description of Artificial Sequence: Synthetic oligonucleotide
gggccccuguggggaaacga

SEQ ID NO: 1136 - RNA, 20 nt, Artificial Sequence
  Description of Artificial Sequence: Synthetic oligonucleotide
gcaagugcaggagucaguga

SEQ ID NO: 1137 - RNA, 20 nt, Artificial Sequence
  Description of Artificial Sequence: Synthetic oligonucleotide
cggaaccaguaaccaugaac

SEQ ID NO: 1138 - RNA, 20 nt, Artificial Sequence
  Description of Artificial Sequence: Synthetic oligonucleotide
ggaaccaguaaccaugaacu

SEQ ID NO: 1139 - RNA, 20 nt, Artificial Sequence
  Description of Artificial Sequence: Synthetic oligonucleotide
gaaccaguaaccaugaacug

SEQ ID NO: 1140 - RNA, 20 nt, Artificial Sequence
  Description of Artificial Sequence: Synthetic oligonucleotide
gcuagaucaagaaguacagg

SEQ ID NO: 1141 - RNA, 20 nt, Artificial Sequence
  Description of Artificial Sequence: Synthetic oligonucleotide
agaaguacaggaggagacuc

SEQ ID NO: 1142 - RNA, 20 nt, Artificial Sequence
  Description of Artificial Sequence: Synthetic oligonucleotide
caagucuagugaggagaaag

SEQ ID NO: 1143 - RNA, 20 nt, Artificial Sequence
  Description of Artificial Sequence: Synthetic oligonucleotide
aagucuagugaggagaaaga

SEQ ID NO: 1144 - RNA, 20 nt, Artificial Sequence
  Description of Artificial Sequence: Synthetic oligonucleotide
agucuagugaggagaaagag

SEQ ID NO: 1145 - RNA, 20 nt, Artificial Sequence
  Description of Artificial Sequence: Synthetic oligonucleotide
accugucaggugaaguucgc

SEQ ID NO: 1146 - RNA, 20 nt, Artificial Sequence
  Description of Artificial Sequence: Synthetic oligonucleotide
acuuacaggugacguugagc

SEQ ID NO: 1147 - RNA, 20 nt, Artificial Sequence
  Description of Artificial Sequence: Synthetic oligonucleotide
aacaucuaggagaggaagag

SEQ ID NO: 1148 - RNA, 20 nt, Artificial Sequence
  Description of Artificial Sequence: Synthetic oligonucleotide
guuccacagaacccaacaac

SEQ ID NO: 1149 - RNA, 20 nt, Artificial Sequence
  Description of Artificial Sequence: Synthetic oligonucleotide
uuccuaccugagccaucucc

SEQ ID NO: 1150 - RNA, 20 nt, Artificial Sequence
  Description of Artificial Sequence: Synthetic oligonucleotide
augcucacaugaagaagaug

SEQ ID NO: 1151 - RNA, 20 nt, Artificial Sequence
  Description of Artificial Sequence: Synthetic oligonucleotide
ucacucugaugggagacacc

SEQ ID NO: 1152 - RNA, 20 nt, Artificial Sequence
  Description of Artificial Sequence: Synthetic oligonucleotide
cacucugaugggagacacca

SEQ ID NO: 1153 - RNA, 20 nt, Artificial Sequence
  Description of Artificial Sequence: Synthetic oligonucleotide
uuucuuauggagaggaaaga

SEQ ID NO: 1154 - RNA, 20 nt, Artificial Sequence
  Description of Artificial Sequence: Synthetic oligonucleotide
guacagguaagagcaacgcc

SEQ ID NO: 1155 - RNA, 20 nt, Artificial Sequence
  Description of Artificial Sequence: Synthetic oligonucleotide
cucuuaccuguaccauaacc

SEQ ID NO: 1156 - RNA, 20 nt, Artificial Sequence
  Description of Artificial Sequence: Synthetic oligonucleotide
uuaccuguaccauaaccagg

SEQ ID NO: 1157 - RNA, 20 nt, Artificial Sequence
  Description of Artificial Sequence: Synthetic oligonucleotide
uguaucuguaggaggagaag

SEQ ID NO: 1158 - RNA, 20 nt, Artificial Sequence
  Description of Artificial Sequence: Synthetic oligonucleotide
guaucuguaggaggagaagu

SEQ ID NO: 1159 - RNA, 20 nt, Artificial Sequence
  Description of Artificial Sequence: Synthetic oligonucleotide
cagauacaaacuggacucuc

SEQ ID NO: 1160 - RNA, 20 nt, Artificial Sequence
  Description of Artificial Sequence: Synthetic oligonucleotide
ucuuaccuuccuucguuugc

SEQ ID NO: 1161 - RNA, 20 nt, Artificial Sequence
  Description of Artificial Sequence: Synthetic oligonucleotide
uuuggaucuaaaacggugac

SEQ ID NO: 1162 - RNA, 20 nt, Artificial Sequence
  Description of Artificial Sequence: Synthetic oligonucleotide
gaucuaaaacggugacaggu

SEQ ID NO: 1163 - RNA, 20 nt, Artificial Sequence
  Description of Artificial Sequence: Synthetic oligonucleotide
aaaggcucagcaguugaccu

SEQ ID NO: 1164 - RNA, 20 nt, Artificial Sequence
  Description of Artificial Sequence: Synthetic oligonucleotide
auuuaccggcauagaauagu

SEQ ID NO: 1165 - RNA, 20 nt, Artificial Sequence
  Description of Artificial Sequence: Synthetic oligonucleotide
ucacugccuaagagagacau

SEQ ID NO: 1166 - RNA, 20 nt, Artificial Sequence
  Description of Artificial Sequence: Synthetic oligonucleotide
aggauccacguggagaaugg

SEQ ID NO: 1167 - RNA, 20 nt, Artificial Sequence
  Description of Artificial Sequence: Synthetic oligonucleotide
ggauccacguggagaauggu

SEQ ID NO: 1168 - RNA, 20 nt, Artificial Sequence
  Description of Artificial Sequence: Synthetic oligonucleotide
ucucacuguucucagggaag

SEQ ID NO: 1169 - RNA, 20 nt, Artificial Sequence
  Description of Artificial Sequence: Synthetic oligonucleotide
ccugcccaaggcuucccacc

SEQ ID NO: 1170 - RNA, 20 nt, Artificial Sequence
  Description of Artificial Sequence: Synthetic oligonucleotide
cugcccaaggcuucccaccu

SEQ ID NO: 1171 - RNA, 20 nt, Artificial Sequence
  Description of Artificial Sequence: Synthetic oligonucleotide
gccugcugcgguaagcggua

SEQ ID NO: 1172 - RNA, 20 nt, Artificial Sequence
  Description of Artificial Sequence: Synthetic oligonucleotide
gaugcucagggaacacguau

SEQ ID NO: 1173 - RNA, 20 nt, Artificial Sequence
  Description of Artificial Sequence: Synthetic oligonucleotide
uucucaaaguucccacaucc

SEQ ID NO: 1174 - RNA, 20 nt, Artificial Sequence
  Description of Artificial Sequence: Synthetic oligonucleotide
ucacagauuggugaguagcc

SEQ ID NO: 1175 - RNA, 20 nt, Artificial Sequence
  Description of Artificial Sequence: Synthetic oligonucleotide
cucaccuguucugugauuac

SEQ ID NO: 1176 - RNA, 20 nt, Artificial Sequence
  Description of Artificial Sequence: Synthetic oligonucleotide
uccuuccagcuacucaaucc

SEQ ID NO: 1177 - RNA, 20 nt, Artificial Sequence
  Description of Artificial Sequence: Synthetic oligonucleotide
cacaguacaaauaagagccc

SEQ ID NO: 1178 - RNA, 20 nt, Artificial Sequence
  Description of Artificial Sequence: Synthetic oligonucleotide
ccccccagcgcuucggugag

SEQ ID NO: 1179 - RNA, 20 nt, Artificial Sequence
  Description of Artificial Sequence: Synthetic oligonucleotide
cccccagcgcuucggugagu

SEQ ID NO: 1180 - RNA, 20 nt, Artificial Sequence
  Description of Artificial Sequence: Synthetic oligonucleotide
ccacucaccgaagcgcuggg

SEQ ID NO: 1181 - RNA, 20 nt, Artificial Sequence
  Description of Artificial Sequence: Synthetic oligonucleotide
uaccucggaggaaagagaaa

SEQ ID NO: 1182 - RNA, 20 nt, Artificial Sequence
  Description of Artificial Sequence: Synthetic oligonucleotide
cagcuuccaaaacgacaagc

SEQ ID NO: 1183 - RNA, 20 nt, Artificial Sequence
  Description of Artificial Sequence: Synthetic oligonucleotide
aacauaccagcuugucguuu

SEQ ID NO: 1184 - RNA, 20 nt, Artificial Sequence
  Description of Artificial Sequence: Synthetic oligonucleotide
agaccaccugcagagacgag

SEQ ID NO: 1185 - RNA, 20 nt, Artificial Sequence
  Description of Artificial Sequence: Synthetic oligonucleotide
ccaccugcagagacgagagg

SEQ ID NO: 1186 - RNA, 20 nt, Artificial Sequence
  Description of Artificial Sequence: Synthetic oligonucleotide
cccaccagcucagcuccacg

SEQ ID NO: 1187 - RNA, 20 nt, Artificial Sequence
  Description of Artificial Sequence: Synthetic oligonucleotide
cgcugucaaguccaguucua

SEQ ID NO: 1188 - RNA, 20 nt, Artificial Sequence
  Description of Artificial Sequence: Synthetic oligonucleotide
gcugucaaguccaguucuac

SEQ ID NO: 1189 - RNA, 20 nt, Artificial Sequence
  Description of Artificial Sequence: Synthetic oligonucleotide
cacccagaucgucagcgccg

SEQ ID NO: 1190 - RNA, 20 nt, Artificial Sequence
  Description of Artificial Sequence: Synthetic oligonucleotide
ccacucaccugcucuacccc

SEQ ID NO: 1191 - RNA, 20 nt, Artificial Sequence
  Description of Artificial Sequence: Synthetic oligonucleotide
ccacagucugaaagaaagca

SEQ ID NO: 1192 - RNA, 20 nt, Artificial Sequence
  Description of Artificial Sequence: Synthetic oligonucleotide
gacacuguuggcacggagga

SEQ ID NO: 1193 - RNA, 20 nt, Artificial Sequence
  Description of Artificial Sequence: Synthetic oligonucleotide
uuaccauggccaucaacaca

SEQ ID NO: 1194 - RNA, 20 nt, Artificial Sequence
  Description of Artificial Sequence: Synthetic oligonucleotide
ccacagucugaaagaaaaca

SEQ ID NO: 1195 - RNA, 20 nt, Artificial Sequence
  Description of Artificial Sequence: Synthetic oligonucleotide
cacagucugaaagaaaacag

SEQ ID NO: 1196 - RNA, 20 nt, Artificial Sequence
  Description of Artificial Sequence: Synthetic oligonucleotide
uuaccauggccaucagcacg

SEQ ID NO: 1197 - RNA, 20 nt, Artificial Sequence
  Description of Artificial Sequence: Synthetic oligonucleotide
ucugcguucagggguaagcg

SEQ ID NO: 1198 - RNA, 20 nt, Artificial Sequence
  Description of Artificial Sequence: Synthetic oligonucleotide
gcgcuuaccccugaacgcag

SEQ ID NO: 1199 - RNA, 20 nt, Artificial Sequence
  Description of Artificial Sequence: Synthetic oligonucleotide
gacugggcagcggccccugu

SEQ ID NO: 1200 - RNA, 20 nt, Artificial Sequence
  Description of Artificial Sequence: Synthetic oligonucleotide
ggacugggcagcggccccug

SEQ ID NO: 1201 - RNA, 20 nt, Artificial Sequence
  Description of Artificial Sequence: Synthetic oligonucleotide
gucaugcagcccuugccugc

SEQ ID NO: 1202 - RNA, 20 nt, Artificial Sequence
  Description of Artificial Sequence: Synthetic oligonucleotide
ucaugcagcccuugccugcu

SEQ ID NO: 1203 - RNA, 20 nt, Artificial Sequence
  Description of Artificial Sequence: Synthetic oligonucleotide
caugcagcccuugccugcug

SEQ ID NO: 1204 - RNA, 20 nt, Artificial Sequence
  Description of Artificial Sequence: Synthetic oligonucleotide
cucaccagauucccgaaggu

SEQ ID NO: 1205 - RNA, 20 nt, Artificial Sequence
  Description of Artificial Sequence: Synthetic oligonucleotide
cagacucaccagauucccga

SEQ ID NO: 1206 - RNA, 20 nt, Artificial Sequence
  Description of Artificial Sequence: Synthetic oligonucleotide
agccuaggcaagugcagagg

SEQ ID NO: 1207 - RNA, 20 nt, Artificial Sequence
  Description of Artificial Sequence: Synthetic oligonucleotide
cagccuaggcaagugcagag

SEQ ID NO: 1208 - RNA, 20 nt, Artificial Sequence
  Description of Artificial Sequence: Synthetic oligonucleotide
accagccuaggcaagugcag

SEQ ID NO: 1209 - RNA, 20 nt, Artificial Sequence
  Description of Artificial Sequence: Synthetic oligonucleotide
uggaaccccaauaccagccu

SEQ ID NO: 1210 - RNA, 20 nt, Artificial Sequence
  Description of Artificial Sequence: Synthetic oligonucleotide
caccugcagaagaugccaga

SEQ ID NO: 1211 - RNA, 20 nt, Artificial Sequence
  Description of Artificial Sequence: Synthetic oligonucleotide
cgcucaccugcaccagccuc

SEQ ID NO: 1212 - RNA, 20 nt, Artificial Sequence
  Description of Artificial Sequence: Synthetic oligonucleotide
cuuccuggcaagacacaaga

SEQ ID NO: 1213 - RNA, 20 nt, Artificial Sequence
  Description of Artificial Sequence: Synthetic oligonucleotide
aauucagggagccauugaaa

SEQ ID NO: 1214 - RNA, 20 nt, Artificial Sequence
  Description of Artificial Sequence: Synthetic oligonucleotide
cuacugaccugccuuuucaa

SEQ ID NO: 1215 - RNA, 20 nt, Artificial Sequence
  Description of Artificial Sequence: Synthetic oligonucleotide
gccucucaaagucuuaugug

SEQ ID NO: 1216 - RNA, 20 nt, Artificial Sequence
  Description of Artificial Sequence: Synthetic oligonucleotide
uucccaugcugcuuuacuuc

SEQ ID NO: 1217 - RNA, 20 nt, Artificial Sequence
  Description of Artificial Sequence: Synthetic oligonucleotide
uuuaggucaaccagauguag

SEQ ID NO: 1218 - RNA, 20 nt, Artificial Sequence
  Description of Artificial Sequence: Synthetic oligonucleotide
ugugccugaaagcaaaaaug

SEQ ID NO: 1219 - RNA, 20 nt, Artificial Sequence
  Description of Artificial Sequence: Synthetic oligonucleotide
uuaccuacuauucuugccag

SEQ ID NO: 1220 - RNA, 20 nt, Artificial Sequence
  Description of Artificial Sequence: Synthetic oligonucleotide
aaaugcuguuuaaaaaaagg

SEQ ID NO: 1221 - RNA, 20 nt, Artificial Sequence
  Description of Artificial Sequence: Synthetic oligonucleotide
ccccaaaaagugaauaucaa

SEQ ID NO: 1222 - RNA, 20 nt, Artificial Sequence
  Description of Artificial Sequence: Synthetic oligonucleotide
guccagaauuuccagaagua

SEQ ID NO: 1223 - RNA, 20 nt, Artificial Sequence
  Description of Artificial Sequence: Synthetic oligonucleotide
ucccuggaggggugggggag

SEQ ID NO: 1224 - RNA, 20 nt, Artificial Sequence
  Description of Artificial Sequence: Synthetic oligonucleotide
ucacuucaacaggacuccua

SEQ ID NO: 1225 - RNA, 20 nt, Artificial Sequence
  Description of Artificial Sequence: Synthetic oligonucleotide
ccuuacacucaaaggcaaag

SEQ ID NO: 1226 - RNA, 20 nt, Artificial Sequence
  Description of Artificial Sequence: Synthetic oligonucleotide
auggcugcagggagaggaag

SEQ ID NO: 1227 - RNA, 20 nt, Artificial Sequence
  Description of Artificial Sequence: Synthetic oligonucleotide
ggagcgccaggggaugcugg

SEQ ID NO: 1228 - RNA, 20 nt, Artificial Sequence
  Description of Artificial Sequence: Synthetic oligonucleotide
ucacgucccaugcagccaca

SEQ ID NO: 1229 - RNA, 20 nt, Artificial Sequence
  Description of Artificial Sequence: Synthetic oligonucleotide
uggacgucugguggggagua

SEQ ID NO: 1230 - RNA, 20 nt, Artificial Sequence
  Description of Artificial Sequence: Synthetic oligonucleotide
acucacauugaugaggaaga

SEQ ID NO: 1231 - RNA, 20 nt, Artificial Sequence
  Description of Artificial Sequence: Synthetic oligonucleotide
cagcaucugagaaaggcaga

SEQ ID NO: 1232 - RNA, 20 nt, Artificial Sequence
  Description of Artificial Sequence: Synthetic oligonucleotide
aauccaacaccucagcgaug

SEQ ID NO: 1233 - RNA, 20 nt, Artificial Sequence
  Description of Artificial Sequence: Synthetic oligonucleotide
auccaacaccucagcgaugu

SEQ ID NO: 1234 - RNA, 20 nt, Artificial Sequence
  Description of Artificial Sequence: Synthetic oligonucleotide
cgcggcgcaguacccgcugc

SEQ ID NO: 1235 - RNA, 20 nt, Artificial Sequence
  Description of Artificial Sequence: Synthetic oligonucleotide
cacucaccguggugggucgg

SEQ ID NO: 1236 - RNA, 20 nt, Artificial Sequence
  Description of Artificial Sequence: Synthetic oligonucleotide
acucaccguggugggucgga

SEQ ID NO: 1237 - RNA, 20 nt, Artificial Sequence
  Description of Artificial Sequence: Synthetic oligonucleotide
uggcucccuguggggcaacg

SEQ ID NO: 1238 - RNA, 20 nt, Artificial Sequence
  Description of Artificial Sequence: Synthetic oligonucleotide
gauuccagggggaggcggug

SEQ ID NO: 1239 - RNA, 20 nt, Artificial Sequence
  Description of Artificial Sequence: Synthetic oligonucleotide
gcuccuaccugugcuggacc

SEQ ID NO: 1240 - RNA, 20 nt, Artificial Sequence
  Description of Artificial Sequence: Synthetic oligonucleotide
ucgccgccacaguggggucg

SEQ ID NO: 1241 - RNA, 20 nt, Artificial Sequence
  Description of Artificial Sequence: Synthetic oligonucleotide
cagacugagaguggggagag

SEQ ID NO: 1242 - RNA, 20 nt, Artificial Sequence
  Description of Artificial Sequence: Synthetic oligonucleotide
ccuccuccagagugugguug

SEQ ID NO: 1243 - RNA, 20 nt, Artificial Sequence
  Description of Artificial Sequence: Synthetic oligonucleotide
agccaucccagggagagagc

SEQ ID NO: 1244 - RNA, 20 nt, Artificial Sequence
  Description of Artificial Sequence: Synthetic oligonucleotide
gccaucccagggagagagcu

SEQ ID NO: 1245 - RNA, 20 nt, Artificial Sequence
  Description of Artificial Sequence: Synthetic oligonucleotide
ccaucccagggagagagcug

SEQ ID NO: 1246 - RNA, 20 nt, Artificial Sequence
  Description of Artificial Sequence: Synthetic oligonucleotide
cucacaggccacccaccagc

SEQ ID NO: 1247 - RNA, 20 nt, Artificial Sequence
  Description of Artificial Sequence: Synthetic oligonucleotide
ccgcuuccagaagugccugg

SEQ ID NO: 1248 - RNA, 20 nt, Artificial Sequence
  Description of Artificial Sequence: Synthetic oligonucleotide
cuuccagaagugccuggcgg

SEQ ID NO: 1249 - RNA, 20 nt, Artificial Sequence
  Description of Artificial Sequence: Synthetic oligonucleotide
acaacugcaaaggaaugggu

SEQ ID NO: 1250 - RNA, 20 nt, Artificial Sequence
  Description of Artificial Sequence: Synthetic oligonucleotide
caacugcaaaggaaugggua

SEQ ID NO: 1251 - RNA, 20 nt, Artificial Sequence
  Description of Artificial Sequence: Synthetic oligonucleotide
gaacuaggaagacgguccag

SEQ ID NO: 1252 - RNA, 20 nt, Artificial Sequence
  Description of Artificial Sequence: Synthetic oligonucleotide
ggcugaccaggaccuguugc

SEQ ID NO: 1253 - RNA, 20 nt, Artificial Sequence
  Description of Artificial Sequence: Synthetic oligonucleotide
cucaccuguacgccaggcgg

SEQ ID NO: 1254 - RNA, 20 nt, Artificial Sequence
  Description of Artificial Sequence: Synthetic oligonucleotide
gcucucaccuguacgccagg

SEQ ID NO: 1255 - RNA, 20 nt, Artificial Sequence
  Description of Artificial Sequence: Synthetic oligonucleotide
cuuagaccuggcaggcagau

SEQ ID NO: 1256 - RNA, 20 nt, Artificial Sequence
  Description of Artificial Sequence: Synthetic oligonucleotide
caauccaguccccgaagcca

SEQ ID NO: 1257 - RNA, 20 nt, Artificial Sequence
  Description of Artificial Sequence: Synthetic oligonucleotide
aauccaguccccgaagccac

SEQ ID NO: 1258 - RNA, 20 nt, Artificial Sequence
  Description of Artificial Sequence: Synthetic oligonucleotide
acucaccggugaugaggaca

SEQ ID NO: 1259 - RNA, 20 nt, Artificial Sequence
  Description of Artificial Sequence: Synthetic oligonucleotide
cucaccggugaugaggacaa

SEQ ID NO: 1260 - RNA, 20 nt, Artificial Sequence
  Description of Artificial Sequence: Synthetic oligonucleotide
ccggucugcgggaaggguac

SEQ ID NO: 1261 - RNA, 20 nt, Artificial Sequence
  Description of Artificial Sequence: Synthetic oligonucleotide
ugggcugcaggagccgcggc

SEQ ID NO: 1262 - RNA, 20 nt, Artificial Sequence
  Description of Artificial Sequence: Synthetic oligonucleotide
uuguaccaaaugccccuguc

SEQ ID NO: 1263 - RNA, 20 nt, Artificial Sequence
  Description of Artificial Sequence: Synthetic oligonucleotide
cggacagcaguccuccauua

SEQ ID NO: 1264 - RNA, 20 nt, Artificial Sequence
  Description of Artificial Sequence: Synthetic oligonucleotide
aggugcagcacagccccaug

SEQ ID NO: 1265 - RNA, 20 nt, Artificial Sequence
  Description of Artificial Sequence: Synthetic oligonucleotide
ggugcagcacagccccaugu

SEQ ID NO: 1266 - RNA, 20 nt, Artificial Sequence
  Description of Artificial Sequence: Synthetic oligonucleotide
aguugccagaugcgcuucga

SEQ ID NO: 1267 - RNA, 20 nt, Artificial Sequence
  Description of Artificial Sequence: Synthetic oligonucleotide
guugccagaugcgcuucgac

SEQ ID NO: 1268 - RNA, 20 nt, Artificial Sequence
  Description of Artificial Sequence: Synthetic oligonucleotide
gucucagcugcucgacacgc

SEQ ID NO: 1269 - RNA, 20 nt, Artificial Sequence
  Description of Artificial Sequence: Synthetic oligonucleotide
uucuuacccuggaauagucc

SEQ ID NO: 1270 - RNA, 20 nt, Artificial Sequence
  Description of Artificial Sequence: Synthetic oligonucleotide
auuaccuguaugcuaaucga

SEQ ID NO: 1271 - RNA, 20 nt, Artificial Sequence
  Description of Artificial Sequence: Synthetic oligonucleotide
uugcaaugcguucguggcuu

SEQ ID NO: 1272 - RNA, 20 nt, Artificial Sequence
  Description of Artificial Sequence: Synthetic oligonucleotide
acugaccugugaccauagcc

SEQ ID NO: 1273 - RNA, 20 nt, Artificial Sequence
  Description of Artificial Sequence: Synthetic oligonucleotide
uaucugcagggacagagaaa

SEQ ID NO: 1274 - RNA, 20 nt, Artificial Sequence
  Description of Artificial Sequence: Synthetic oligonucleotide
ugcggcgcagacauacagcu

SEQ ID NO: 1275 - RNA, 20 nt, Artificial Sequence
  Description of Artificial Sequence: Synthetic oligonucleotide
ccccgcaggcgggggcguua

SEQ ID NO: 1276 - RNA, 20 nt, Artificial Sequence
  Description of Artificial Sequence: Synthetic oligonucleotide
uuucagaagugucucagugu

SEQ ID NO: 1277 - RNA, 20 nt, Artificial Sequence
  Description of Artificial Sequence: Synthetic oligonucleotide
auuaccugauggaaagucug

SEQ ID NO: 1278 - RNA, 20 nt, Artificial Sequence
  Description of Artificial Sequence: Synthetic oligonucleotide
cuucagugccuucguggauu

SEQ ID NO: 1279 - RNA, 20 nt, Artificial Sequence
  Description of Artificial Sequence: Synthetic oligonucleotide
uuucugcagagggauagaga

SEQ ID NO: 1280 - RNA, 20 nt, Artificial Sequence
  Description of Artificial Sequence: Synthetic oligonucleotide
agaccaccagaguaagggac

SEQ ID NO: 1281 - RNA, 20 nt, Artificial Sequence
  Description of Artificial Sequence: Synthetic oligonucleotide
acuugcagcccucggccaaa

SEQ ID NO: 1282 - RNA, 20 nt, Artificial Sequence
  Description of Artificial Sequence: Synthetic oligonucleotide
agggcucaccagagguagga

SEQ ID NO: 1283 - RNA, 20 nt, Artificial Sequence
  Description of Artificial Sequence: Synthetic oligonucleotide
uucaccugcccaaggaaaaa

SEQ ID NO: 1284 - RNA, 20 nt, Artificial Sequence
  Description of Artificial Sequence: Synthetic oligonucleotide
cuaagccuagaaaaucaguu

SEQ ID NO: 1285 - RNA, 20 nt, Artificial Sequence
  Description of Artificial Sequence: Synthetic oligonucleotide
acaucuagaaaaaaaaauac

SEQ ID NO: 1286 - RNA, 20 nt, Artificial Sequence
  Description of Artificial Sequence: Synthetic oligonucleotide
auuaccuuccucuuugcacu

SEQ ID NO: 1287 - RNA, 20 nt, Artificial Sequence
  Description of Artificial Sequence: Synthetic oligonucleotide
gauccuguagguuggaacau

SEQ ID NO: 1288 - RNA, 20 nt, Artificial Sequence
  Description of Artificial Sequence: Synthetic oligonucleotide
aagccaccccaaguuagauc

SEQ ID NO: 1289 - RNA, 20 nt, Artificial Sequence
  Description of Artificial Sequence: Synthetic oligonucleotide
aacuuaccccaaacaauuag

SEQ ID NO: 1290 - RNA, 20 nt, Artificial Sequence
  Description of Artificial Sequence: Synthetic oligonucleotide
auaccuacaggauuuaaagu

SEQ ID NO: 1291 - RNA, 20 nt, Artificial Sequence
  Description of Artificial Sequence: Synthetic oligonucleotide
guuuccuagaaagcaaaaaa

SEQ ID NO: 1292 - RNA, 20 nt, Artificial Sequence
  Description of Artificial Sequence: Synthetic oligonucleotide
aaguucaacugcuucguaau

SEQ ID NO: 1293 - RNA, 20 nt, Artificial Sequence
  Description of Artificial Sequence: Synthetic oligonucleotide
aauucagacuaucauccuca

SEQ ID NO: 1294 - RNA, 20 nt, Artificial Sequence
  Description of Artificial Sequence: Synthetic oligonucleotide
gcuugcagcugugggacacc

SEQ ID NO: 1295 - RNA, 20 nt, Artificial Sequence
  Description of Artificial Sequence: Synthetic oligonucleotide
gaccacucaaccagugccca

SEQ ID NO: 1296 - RNA, 20 nt, Artificial Sequence
  Description of Artificial Sequence: Synthetic oligonucleotide
ggaggcacagaccacuccac

SEQ ID NO: 1297 - RNA, 20 nt, Artificial Sequence
  Description of Artificial Sequence: Synthetic oligonucleotide
ggcacagacaacucgacuga

SEQ ID NO: 1298 - RNA, 20 nt, Artificial Sequence
  Description of Artificial Sequence: Synthetic oligonucleotide
gcacagaccacucaacccac

SEQ ID NO: 1299 - RNA, 20 nt, Artificial Sequence
  Description of Artificial Sequence: Synthetic oligonucleotide
gaccacucaacccacaggcc

SEQ ID NO: 1300 - RNA, 20 nt, Artificial Sequence
  Description of Artificial Sequence: Synthetic oligonucleotide
gaccacucaaaccacagcca

SEQ ID NO: 1301 - RNA, 20 nt, Artificial Sequence
  Description of Artificial Sequence: Synthetic oligonucleotide
gaccacucaacccacagcca

SEQ ID NO: 1302 - RNA, 20 nt, Artificial Sequence
  Description of Artificial Sequence: Synthetic oligonucleotide
gaccacucaaccagcagcca

SEQ ID NO: 1303 - DNA, 20 bp, Unknown
  Description of Unknown: target sequence
cctgcagagaaacacacttg

SEQ ID NO: 1304 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESVLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 1305 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 1306 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 1307 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 1308 - protein, 4 aa, Artificial Sequence
  Description of Artificial Sequence: Synthetic peptide
GGGS

SEQ ID NO: 1309 - protein, 5 aa, Artificial Sequence
  Description of Artificial Sequence: Synthetic peptide
EAAAK

SEQ ID NO: 1310 - protein, 20 aa, Artificial Sequence
  Description of Artificial Sequence: Synthetic peptide
GSSGSETPGTSESATPESSG

SEQ ID NO: 1311 - DNA, 18 bp, Artificial Sequence
  Description of Artificial Sequence: Synthetic oligonucleotide
ggaggctctggaggaagc

SEQ ID NO: 1312 - DNA, 60 bp, Artificial Sequence
  Description of Artificial Sequence: Synthetic oligonucleotide
ggctcttctggatctgaaacacctggcacaagcgagagcgccacccctgagagctctggc

SEQ ID NO: 1313 - protein, 17 aa, Unknown
  Description of Unknown: nuclear localization signal sequence
MAPKKKRKVGIHGVPAA

SEQ ID NO: 1314 - DNA, 51 bp, Unknown
  Description of Unknown: nuclear localization signal sequence
atggccccaaagaagaagcggaaggtcggtatccacggagtcccagcagcc

SEQ ID NO: 1315 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1316 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1317 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1318 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1319 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDTGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1320 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1321 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1322 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1323 - protein, 1540 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1324 - protein, 1540 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1325 - protein, 1543 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1326 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1327 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1328 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1329 - protein, 1551 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1330 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1331 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1332 - protein, 1533 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSETPGTSESATPESSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1333 - protein, 1549 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1334 - protein, 1555 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSSGSETPGTSESATPESSGGSSIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1335 - protein, 1421 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1336 - protein, 1552 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1337 - protein, 1545 aa, Artificial Sequence
  Description of Artificial Sequence: Synthetic polypeptide
MSEVEFSHEYWMRHALTLAKRARDEREVPVGAVLVLNNRVIGEGWNRTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1338 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1339 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1340 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQSEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1341 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1342 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1343 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1344 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQLGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1345 - protein, 1484 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1346 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1347 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1348 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1349 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLAMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGNGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1350 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1351 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGDKPIREQAENIIHLFTLTNLGAPAAFKYFDTTIDRKRYTSTKEVLDATLIHQSITGLYETRIDLSQLGGD

SEQ ID NO: 1352 - protein, 1454 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1353 - protein, 1420 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1354 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1355 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1356 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMITAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1357 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEITAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1358 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1359 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1360 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1361 - protein, 167 aa, Unknown
  Description of Unknown: TadA sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 1362 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 1363 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 1364 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 1365 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 1366 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 1367 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 1368 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 1369 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 1370 - protein, 167 aa, Escherichia coli; identical to SEQ ID NO: 8

SEQ ID NO: 1371 - RNA, 20 nt, Artificial Sequence
  Description of Artificial Sequence: Synthetic oligonucleotide
auggggcucagaggcuguaa

SEQ ID NO: 1372 - protein, 198 aa, Homo sapiens [sequence omitted]

SEQ ID NO: 1373 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 1374 - protein, 198 aa, Canis lupus familiaris
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 1375 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 1376 - protein, 239 aa, Rattus norvegicus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 1377 - protein, 198 aa, Mus musculus [sequence omitted]

SEQ ID NO: 1378 - protein, 229 aa, Rattus norvegicus [sequence omitted]

SEQ ID NO: 1379 - protein, 229 aa, Mesocricetus auratus
MSSETGPVVVDPTLRRRIEPHEFDAFFDQGELRKETCLLYEIRWGGRHNIWRHTGQNTSRHVEINFIEKFTSERYFYPSTRCSIVWFLSWSPCGECSKAITEFLSGHPNVTLFIYAARLYHHTDQRNRQGLRDLISRGVTIRIMTEQEYCYCWRNFVNYPPSNEVYWPRYPNLWMRLYALELYCIHLGLPPCLKIKRRHQYPLTFFRLNLQSCHYQRIPPHILWATGFI

SEQ ID NO: 1380 - protein, 236 aa, Pongo pygmaeus
MTSEKGPSTGDPTLRRRIESWEFDVFYDPRELRKETCLLYEIKWGMSRKIWRSSGKNTTNHVEVNFIKKFTSERRFHSSISCSITWFLSWSPCWECSQAIREFLSQHPGVTLVIYVARLFWHMDQRNRQGLRDLVNSGVTIQIMRASEYYHCWRNFVNYPPGDEAHWPQYPPLWMMLYALELHCIILSLPPCLKISRRWQNHLAFFRLHLQNCHYQTIPPHILLATGLIHPSVTWR

SEQ ID NO: 1381 - protein, 236 aa, Oryctolagus cuniculus
MASEKGPSNKDYTLRRRIEPWEFEVFFDPQELRKEACLLYEIKWGASSKTWRSSGKNTTNHVEVNFLEKLTSEGRLGPSTCCSITWFLSWSPCWECSMAIREFLSQHPGVTLIIFVARLFQHMDRRNRQGLKDLVTSGVTVRVMSVSEYCYCWENFVNYPPGKAAQWPRYPPRWMLMYALELYCIILGLPPCLKISRRHQKQLTFFSLTPQYCHYKMIPPYILLATGLLQPSVPWR

SEQ ID NO: 1382 - protein, 235 aa, Monodelphis domestica
MNSKTGPSVGDATLRRRIKPWEFVAFFNPQELRKETCLLYEIKWGNQNIWRHSNQNTSQHAEINFMEKFTAERHFNSSVRCSITWFLSWSPCWECSKAIRKFLDHYPNVTLAIFISRLYWHMDQQHRQGLKELVHSGVTIQIMSYSEYHYCWRNFVDYPQGEEDYWPKYPYLWIMLYVLELHCIILGLPPCLKISGSHSNQLALFSLDLQDCHYQKIPYNVLVATGLVQPFVTWR

SEQ ID NO: 1383 - protein, 224 aa, Pongo pygmaeus
MAQKEEAAAATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEELEIQDALKKLKEAGCKLRIMKPQDFEYVWQNFVEQEEGESKAFQPWEDIQENFLYYEEKLADILK

SEQ ID NO: 1384 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 1385 - protein, 440 aa, Mus musculus
MQPQRLGPRAGMGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYISVPSSSSSTLSNICLTKGLPETRFWVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 1386 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 1387 - protein, 430 aa, Rattus norvegicus
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 1388 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 1389 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 1390 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 1391 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 1392 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 1393 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 1394 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 1395 - protein, 395 aa, Rattus norvegicus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 1396 - protein, 226 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 1397 - protein, 490 aa, Pan troglodytes
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 1398 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 1399 - protein, 190 aa, Gorilla gorilla
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 1400 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 1401 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 1402 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 1403 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 1404 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 1405 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 1406 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 1407 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 1408 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 1409 - protein, 224 aa, Rattus norvegicus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 1410 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 1411 - protein, 381 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 1412 - protein, 182 aa, Homo sapiens
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 1413 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 1414 - protein, 367 aa, Homo sapiens
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGRSVEIVEITEQFASSKEADEKKKKKGKK

SEQ ID NO: 1415 - protein, 388 aa, Rattus norvegicus
MEPLYEEYLTHSGTIVKPYYWLSVSLNCTNCPYHIRTGEEARVPYTEFHQTFGFPWSTYPQTKHLTFYELRSSSGNLIQKGLASNCTGSHTHPESMLFERDGYLDSLIFHDSNIRHIILYSNNSPCDEANHCCISKMYNFLMNYPEVTLSVFFSQLYHTENQFPTSAWNREALRGLASLWPQVTLSAISGGIWQSILETFVSGISEGLTAVRPFTAGRTLTDRYNAYEINCITEVKPYFTDALHSWQKENQDQKVWAASENQPLHNTTPAQWQPDMSQDCRTPAVFMLVPYRDLPPIHVNPSPQKPRTVVRHLNTLQLSASKVKALRKSPSGRPVKKEEARKGSTRSQEANETNKSKWKKQTLFIKSNICHLLEREQKKIGILSSWSV

SEQ ID NO: 1416 - protein, 363 aa, Macaca fascicularis
MEPTYEEYLANHGTIVKPYYWLSFSLDCSNCPYHIRTGEEARVSLTEFCQIFGFPYGTTYPQTKHLTFYELKTSSGSLVQKGHASSCTGNYIHPESMLFEMNGYLDSAIYNNDSIRHIILYCNNSPCNEANHCCISKVYNFLITYPGITLSIYFSQLYHTEMDFPASAWNREALRSLASLWPRVVLSPISGGIWHSVLHSFVSGVSGSHVFQPILTGRALTDRYNAYEINAITGVKPFFTDVLLHTKRNPNTKAQMALESYPLNNAFPGQSFQMTSGIPPDLRAPVVFVLLPLRDLPPMHMGQDPNKPRNIIRHLNMPQMSFQETKDLERLPTRRSVETVEITERFASSKQAEEKTKKKKGKK

SEQ ID NO: 1417 - protein, 224 aa, Petromyzon marinus
MAGYECVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLTMHFSRIYDRDREGDHRGLRGLKHVSNSFRMGVVGRAEVKECLAEYVEASRRTLTWLDTTESMAAKMRRKLFCILVRCAGMRESGIPLHLFTLQTPLLSGRVVWWRV

SEQ ID NO: 1418 - protein, 331 aa, Petromyzon marinus
MELREVVDCALASCVRHEPLSRVAFLRCFAAPSQKPRGTVILFYVEGAGRGVTGGHAVNYNKQGTSIHAEVLLLSAVRAALLRRRRCEDGEEATRGCTLHCYSTYSPCRDCVEYIQEFGASTGVRVVIHCCRLYELDVNRRRSEAEGVLRSLSRLGRDFRLMGPRDAIALLLGGRLANTADGESGASGNAWVTETNVVEPLVDMTGFGDEDLHAQVQRNKQIREAYANYASAVSLMLGELHVDPDKFPFLAEFLAQTSVEPSGTPRETRGRPRGASSRGPEIGRQRPADFERALGAYGLFLHPRIVSREADREEIKRDLIVVMRKHNYQGP

SEQ ID NO: 1419 - protein, 209 aa, Petromyzon marinus
MAGDENVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLMMHFSRIYDRDREGDHRGLRGLKHVSNSFRMGVVGRAEVKECLAEYVEASRRTLTWLDTTESMAAKMRRKLFCILVRCAGMRESGMPLHLFT

SEQ ID NO: 1420 - protein, 158 aa, Saccharomyces cerevisiae
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 1421 - protein, 218 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRGLPPCLNILRRKQPQLTFFTIALQSCHYQRLPPHILWATGLK

SEQ ID NO: 1422 - protein, 218 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQHYQRLPPHILWATGLK

SEQ ID NO: 1423 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1424 - protein, 23 aa, Unknown
  Description of Unknown: nuclear localization sequence
RKSGKIAAIVVKRPRKPKKKRKV

SEQ ID NO: 1425 - protein, 8 aa, Artificial Sequence
  Description of Artificial Sequence: Synthetic peptide
SGGSSGGS

SEQ ID NO: 1426 - protein, 1609 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 1427 - protein, 1807 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDGGSSGGSSGSETPGTSESATPESSGGSSGGSMSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 1428 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 1429 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 1430 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 1431 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 1432 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 1433 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 1434 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 1435 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 1436 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1437 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1438 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1439 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1440 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1441 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1442 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1443 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1444 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHYPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1445 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRRVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1446 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1447 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1448 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1449 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 1450 - protein, 21 aa, Artificial Sequence
  Description of Artificial Sequence: Synthetic peptide
  MISC_FEATURE (1)..(21): This sequence may encompass 1, 3, or 7 "Gly Gly Ser" repeating units
GGSGGSGGSGGSGGSGGSGGS

SEQ ID NO: 1451 - DNA, 8961 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctcctcagagactgggcctgtcgccgtcgatccaaccctgcgccgccggattgaacctcacgagtttgaagtgttctttgacccccgggagctgagaaaggagacatgcctgctgtacgagatcaactggggaggcaggcactccatctggaggcacacctctcagaacacaaataagcacgtggaggtgaacttcatcgagaagtttaccacagagcggtacttctgccccaataccagatgtagcatcacatggtttctgagctggtccccttgcggagagtgtagcagggccatcaccgagttcctgtccagatatccacacgtgacactgtttatctacatcgccaggctgtatcaccacgcagacccaaggaataggcagggcctgcgcgatctgatcagctccggcgtgaccatccagatcatgacagagcaggagtccggctactgctggcggaacttcgtgaattattctcctagcaacgaggcccactggcctaggtacccacacctgtgggtgcgcctgtacgtgctggagctgtattgcatcatcctgggcctgcccccttgtctgaatatcctgcggagaaagcagccccagctgaccttctttacaatcgccctgcagtcttgtcactatcagaggctgccaccccacatcctgtgggccacaggcctgaagtctggaggatctagcggaggatcctctggcagcgagacaccaggaacaagcgagtcagcaacaccagagagcagtggcggcagcagcggcggcagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccggaggatctggaggcagcaccaacctgtctgacatcatcgagaaggagacaggcaagcagctggtcatccaggagagcatcctgatgctgcccgaagaagtcgaagaagtgatcggaaacaagcctgagagcgatatcctggtccataccgcctacgacgagagtaccgacgaaaatgtgatgctgctgacatccgacgccccagagtataagccctgggctctggtcatccaggattccaacggagagaacaaaatcaaaatgctgtctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 1452 - RNA, 100 nt, Artificial Sequence
  Description of Artificial Sequence: Synthetic polynucleotide
uucguaucuguaaaaccaagguuuuagagcuagaaauagcaaguuaaaauaaggcuaguccguuaucaacuugaaaaaguggcaccgagucggugcuuuu

SEQ ID NO: 1453 - RNA, 100 nt, Artificial Sequence
  Description of Artificial Sequence: Synthetic polynucleotide
uuaccuguaccauaaccaggguuuuagagcuagaaauagcaaguuaaaauaaggcuaguccguuaucaacuugaaaaaguggcaccgagucggugcuuuu

SEQ ID NO: 1454 - RNA, 100 nt, Artificial Sequence
  Description of Artificial Sequence: Synthetic polynucleotide
cucuuaccuguaccauaaccguuuuagagcuagaaauagcaaguuaaaauaaggcuaguccguuaucaacuugaaaaaguggcaccgagucggugcuuuu

SEQ ID NO: 1455 - RNA, 100 nt, Artificial Sequence
  Description of Artificial Sequence: Synthetic polynucleotide
ugcaccucuggggaggaccuguuuuagagcuagaaauagcaaguuaaaauaaggcuaguccguuaucaacuugaaaaaguggcaccgagucggugcuuuu

SEQ ID NO: 1456 - RNA, 100 nt, Artificial Sequence
  Description of Artificial Sequence: Synthetic polynucleotide
ccuaccugucaccaggaccaguuuuagagcuagaaauagcaaguuaaaauaaggcuaguccguuaucaacuugaaaaaguggcaccgagucggugcuuuu

SEQ ID NO: 1457 - RNA, 100 nt, Artificial Sequence
  Description of Artificial Sequence: Synthetic polynucleotide
caccuaccuaagaaccauccguuuuagagcuagaaauagcaaguuaaaauaaggcuaguccguuaucaacuugaaaaaguggcaccgagucggugcuuuu

SEQ ID NO: 1458 - RNA, 20 nt, Artificial Sequence
  Description of Artificial Sequence: Synthetic oligonucleotide
acucacccagcauccccagc

SEQ ID NO: 1459 - RNA, 20 nt, Artificial Sequence
  Description of Artificial Sequence: Synthetic oligonucleotide
uggaaaucugggggucagaa

SEQ ID NO: 1460 - RNA, 20 nt, Artificial Sequence
  Description of Artificial Sequence: Synthetic oligonucleotide
guuacccaccuaagcagguc

SEQ ID NO: 1461 - RNA, 20 nt, Artificial Sequence
  Description of Artificial Sequence: Synthetic oligonucleotide
cugccagcggcugaacugug

SEQ ID NO: 1462 - RNA, 20 nt, Artificial Sequence
  Description of Artificial Sequence: Synthetic oligonucleotide
ccucccacugcuuggagcuc

SEQ ID NO: 1463 - RNA, 20 nt, Artificial Sequence
  Description of Artificial Sequence: Synthetic oligonucleotide
ucugccagcggcugaacugu

SEQ ID NO: 1464 - RNA, 20 nt, Artificial Sequence
  Description of Artificial Sequence: Synthetic oligonucleotide
gucugccagcggcugaacug

SEQ ID NO: 1465 - RNA, 20 nt, Artificial Sequence
  Description of Artificial Sequence: Synthetic oligonucleotide
gaagugccagggccagcugg

SEQ ID NO: 1466 - RNA, 20 nt, Artificial Sequence
  Description of Artificial Sequence: Synthetic oligonucleotide
ccaugugccauccguccuug

SEQ ID NO: 1467 - RNA, 20 nt, Artificial Sequence
  Description of Artificial Sequence: Synthetic oligonucleotide
uuugcagccagagcuggggc

SEQ ID NO: 1468 - RNA, 20 nt, Artificial Sequence
  Description of Artificial Sequence: Synthetic oligonucleotide
gguucugcaaugagacacuc

SEQ ID NO: 1469 - RNA, 20 nt, Artificial Sequence
  Description of Artificial Sequence: Synthetic oligonucleotide
gagcuaggagaggagagagc

SEQ ID NO: 1470 - RNA, 20 nt, Artificial Sequence
  Description of Artificial Sequence: Synthetic oligonucleotide
ucacuuaccugagcaaagga

SEQ ID NO: 1471 - RNA, 20 nt, Artificial Sequence
  Description of Artificial Sequence: Synthetic oligonucleotide
cucacuuaccugagcaaagg

SEQ ID NO: 1472 - RNA, 20 nt, Artificial Sequence
  Description of Artificial Sequence: Synthetic oligonucleotide
cugcagcugguggcacaguc

SEQ ID NO: 1473 - RNA, 20 nt, Artificial Sequence
  Description of Artificial Sequence: Synthetic oligonucleotide
cggccagcacugugccggcg

SEQ ID NO: 1474 - RNA, 20 nt, Artificial Sequence
  Description of Artificial Sequence: Synthetic oligonucleotide
aucuuccauuggauuggcaa

SEQ ID NO: 1475 - RNA, 20 nt, Artificial Sequence
  Description of Artificial Sequence: Synthetic oligonucleotide
gaucuuccauuggauuggca

SEQ ID NO: 1476 - RNA, 20 nt, Artificial Sequence
  Description of Artificial Sequence: Synthetic oligonucleotide
aaccugagaggggaagcaau

SEQ ID NO: 1477 - RNA, 20 nt, Artificial Sequence
  Description of Artificial Sequence: Synthetic oligonucleotide
aaaccugagaggggaagcaa

SEQ ID NO: 1478 - RNA, 20 nt, Artificial Sequence
  Description of Artificial Sequence: Synthetic oligonucleotide
gugcagagccgucugguggg

SEQ ID NO: 1479 - RNA, 20 nt, Artificial Sequence
  Description of Artificial Sequence: Synthetic oligonucleotide
cucccaccgcagcgagcucc

SEQ ID NO: 1480 - RNA, 20 nt, Artificial Sequence
  Description of Artificial Sequence: Synthetic oligonucleotide
cucccaaaguucguggcacu

SEQ ID NO: 1481 - RNA, 20 nt, Artificial Sequence
  Description of Artificial Sequence: Synthetic oligonucleotide
aggugcagagccgucuggug

SEQ ID NO: 1482 - RNA, 20 nt, Artificial Sequence
  Description of Artificial Sequence: Synthetic oligonucleotide
ggugcagagccgucuggugg

SEQ ID NO: 1483 - RNA, 20 nt, Artificial Sequence
  Description of Artificial Sequence: Synthetic oligonucleotide
ucucccaaaguucguggcac

SEQ ID NO: 1484 - RNA, 20 nt, Artificial Sequence
  Description of Artificial Sequence: Synthetic oligonucleotide
ugucccagugccacgaacuu

SEQ ID NO: 1485 - RNA, 20 nt, Artificial Sequence
  Description of Artificial Sequence: Synthetic oligonucleotide
aaggugcagagccgucuggu

SEQ ID NO: 1486 - RNA, 20 nt, Artificial Sequence
  Description of Artificial Sequence: Synthetic oligonucleotide
uccuaucgagugcuggacgc

SEQ ID NO: 1487 - RNA, 20 nt, Artificial Sequence
  Description of Artificial Sequence: Synthetic oligonucleotide
caaggugcagagccgucugg

SEQ ID NO: 1488 - RNA, 20 nt, Artificial Sequence
  Description of Artificial Sequence: Synthetic oligonucleotide
ggugcgccagggggcucagu

SEQ ID NO: 1489 - RNA, 20 nt, Artificial Sequence
  Description of Artificial Sequence: Synthetic oligonucleotide
gggcugcccacugagccccc

SEQ ID NO: 1490 - RNA, 20 nt, Artificial Sequence
  Description of Artificial Sequence: Synthetic oligonucleotide
aggugcgccagggggcucag

SEQ ID NO: 1491 - RNA, 20 nt, Artificial Sequence
  Description of Artificial Sequence: Synthetic oligonucleotide
ggccaggauccaaaccccgc

SEQ ID NO: 1492 - RNA, 20 nt, Artificial Sequence
  Description of Artificial Sequence: Synthetic oligonucleotide
cgccaguggauuggcccaac

SEQ ID NO: 1493 - RNA, 20 nt, Artificial Sequence
  Description of Artificial Sequence: Synthetic oligonucleotide
aagaagcagcgccaguggau

SEQ ID NO: 1494 - RNA, 20 nt, Artificial Sequence
  Description of Artificial Sequence: Synthetic oligonucleotide
aaagacacugggcagauggu

SEQ ID NO: 1495 - RNA, 20 nt, Artificial Sequence
  Description of Artificial Sequence: Synthetic oligonucleotide
gcuuaccuggauaagcugac

SEQ ID NO: 1496 - RNA, 20 nt, Artificial Sequence
  Description of Artificial Sequence: Synthetic oligonucleotide
uuccagagcuggggaaagaa

SEQ ID NO: 1497 - DNA, 20 bp, Artificial Sequence
  Description of Artificial Sequence: Synthetic oligonucleotide
  CDS (2)..(19)
ggaggctatccagcgtgagt

SEQ ID NO: 1498 - protein, 6 aa, Artificial Sequence
  Description of Artificial Sequence: Synthetic peptide
EAIQRE

SEQ ID NO: 1499 - DNA, 20 bp, Artificial Sequence
  Description of Artificial Sequence: Synthetic oligonucleotide
cttggttttacagatacgaa

SEQ ID NO: 1500 - DNA, 20 bp, Artificial Sequence
  Description of Artificial Sequence: Synthetic oligonucleotide
ccacacccaaaaggccacac

SEQ ID NO: 1501 - protein, 7 aa, Artificial Sequence
  Description of Artificial Sequence: Synthetic peptide
LGFTDTN

SEQ ID NO: 1502 - DNA, 21 bp, Artificial Sequence
  Description of Artificial Sequence: Synthetic oligonucleotide
  CDS (1)..(21)
ccagacaggccctggaacccc

SEQ ID NO: 1503 - protein, 7 aa, Artificial Sequence
  Description of Artificial Sequence: Synthetic peptide
PDRPWNP

SEQ ID NO: 1504 - DNA, 20 bp, Artificial Sequence
  Description of Artificial Sequence: Synthetic oligonucleotide
caaccggcagcgagggaacg

SEQ ID NO: 1505 - DNA, 20 bp, Artificial Sequence
  Description of Artificial Sequence: Synthetic oligonucleotide
gcagcacccagggcaggacc

SEQ ID NO: 1506 - DNA, 20 bp, Artificial Sequence
  Description of Artificial Sequence: Synthetic oligonucleotide
cagcacccagggcaggacca

SEQ ID NO: 1507 - DNA, 20 bp, Artificial Sequence
  Description of Artificial Sequence: Synthetic oligonucleotide
aggcccaggcggcagggccc

SEQ ID NO: 1508 - DNA, 20 bp, Artificial Sequence
  Description of Artificial Sequence: Synthetic oligonucleotide
cagcaaccagacggacaagc

SEQ ID NO: 1509 - DNA, 20 bp, Artificial Sequence
  Description of Artificial Sequence: Synthetic oligonucleotide
cacccagaaaacaacacagc

SEQ ID NO: 1510 - DNA, 20 bp, Artificial Sequence
  Description of Artificial Sequence: Synthetic oligonucleotide
gagccagccacagggccccc

SEQ ID NO: 1511 - DNA, 20 bp, Artificial Sequence
  Description of Artificial Sequence: Synthetic oligonucleotide
acaggcccaggacacagagc

SEQ ID NO: 1512 - DNA, 20 bp, Artificial Sequence
  Description of Artificial Sequence: Synthetic oligonucleotide
gggaaacaagagaccagagc

What is claimed is:

1. A method for producing a CD7 CAR-expressing immune cell or population of CAR-expressing immune cells having reduced immunogenicity, the method comprising
   a) contacting a target polynucleotide in an immune cell or population of immune cells with a guide polynucleotide and a base editor comprising a fusion protein comprising a nucleic acid programmable DNA binding protein (napDNAbp) and a deaminase domain or a base editor system comprising a guide polynucleotide and a nucleic acid programmable DNA binding protein (napDNAbp) and a deaminase domain;
   b) introducing by nucleobase modification a mutation that reduces or eliminates the expression of a CD7 antigen into the immune cell or the population of immune cells;
   c) introducing by nucleobase modification a mutation that reduces or eliminates the expression of at least one polypeptide selected from the group consisting of CD3e, TRAC, LAG-3, FAS, CIITA, TRBC1, TRBC2, CD52, B2M, and PDC1/PD-1 into the immune cells or the population of immune cells; and
   d) expressing in the immune cell or population of immune cells a chimeric antigen receptor that targets the CD7 antigen thereby producing a CAR-expressing immune cell or population of CAR-expressing immune cells having reduced immunogenicity, wherein the chimeric antigen receptor that targets the CD7 antigen comprises or consists of SEQ ID NO: 113.

2. The method of claim 1, wherein the immune cell or the population of immune cells produced by the method exhibits fratricide resistance and/or increased anti-neoplasia activity as compared to a corresponding control cell.

3. The method of claim 1 wherein the immune cell or the population of immune produced by the method comprises no detectable translocations.

4. The method of claim 1, wherein the immune cell or the population of immune cells produced by the method comprises less than 1% indels.

5. The method of claim 1, wherein the immune cell or the population of immune cells produced by the method comprises less than 5% of non-target edits.

6. The method of claim 1, wherein the mutation is in an exon, in a splice donor site or a splice acceptor site.

7. The method of claim 6, wherein the mutation results in a premature stop codon that reduces or eliminates protein expression.

8. The method of claim 1, wherein the mutation reduces A expression of an encoded polypeptide by at least 50% or more relative to a corresponding control cell lacking the mutation.

9. The method of claim 1, wherein the guide polynucleotide comprises a nucleic acid sequence selected from CUCUUACCUGUACCAUAACC (SEQ ID NO: 1155), CCUACCUGUCACCAGGACCA (SEQ ID NO: 1128), and CACCUACCUAAGAACCAUCC (SEQ ID NO: 897).

10. The method of claim 1, wherein the guide polynucleotide targets the napDNAbp to a gene encoding CD3e, CD5, FAS, LAG-3, CD52, TRAC, B2M, CITA, TRBCI, TRBC2 or PDC1/PD-1, or a regulatory element thereof.

11. The method of claim 1, wherein the base editor and the guide polynucleotide are introduced into the immune cell via electroporation, nucleofection, cationic lipid-mediated methods, viral transduction, or a combination thereof.

12. The method of claim 1, further comprising depleting TCRα/β+ cells from the population of CD7 CAR-expressing immune cells.

\* \* \* \* \*